(12) United States Patent
Barrangou et al.

(10) Patent No.: US 10,450,584 B2
(45) Date of Patent: Oct. 22, 2019

(54) CAS9 PROTEINS AND GUIDING FEATURES FOR DNA TARGETING AND GENOME EDITING

(71) Applicant: North Carolina State University, Raleigh, NC (US)

(72) Inventors: Rodolphe Barrangou, Raleigh, NC (US); Alexandra E. Briner, Raleigh, NC (US)

(73) Assignee: NORTH CAROLINA STATE UNIVERSITY, Raleigh, NC (US)

( * ) Notice: Subject to any disclaimer, the term of this patent is extended or adjusted under 35 U.S.C. 154(b) by 0 days.

(21) Appl. No.: 15/507,176

(22) PCT Filed: Aug. 27, 2015

(86) PCT No.: PCT/US2015/047136
§ 371 (c)(1),
(2) Date: Feb. 27, 2017

(87) PCT Pub. No.: WO2016/033298
PCT Pub. Date: Mar. 3, 2016

(65) Prior Publication Data
US 2017/0275648 A1    Sep. 28, 2017

Related U.S. Application Data

(60) Provisional application No. 62/043,204, filed on Aug. 28, 2014, provisional application No. 62/043,882, filed on Aug. 29, 2014.

(51) Int. Cl.
| | |
|---|---|
| *C12N 15/113* | (2010.01) |
| *C12N 15/85* | (2006.01) |
| *C12N 15/00* | (2006.01) |
| *C12N 9/22* | (2006.01) |
| *C12N 9/96* | (2006.01) |
| *C12N 15/10* | (2006.01) |
| *C12N 15/63* | (2006.01) |
| *C12N 15/79* | (2006.01) |
| *C12N 15/82* | (2006.01) |
| *C12N 15/86* | (2006.01) |
| *C12N 15/90* | (2006.01) |
| *C12N 15/11* | (2006.01) |

(52) U.S. Cl.
CPC .......... *C12N 15/8509* (2013.01); *C12N 9/22* (2013.01); *C12N 9/96* (2013.01); *C12N 15/102* (2013.01); *C12N 15/63* (2013.01); *C12N 15/79* (2013.01); *C12N 15/8213* (2013.01); *C12N 15/86* (2013.01); *C12N 15/907* (2013.01); *A01K 2217/052* (2013.01); *C12N 15/111* (2013.01); *C12N 2310/10* (2013.01); *C12N 2310/20* (2017.05); *C12N 2800/22* (2013.01)

(58) Field of Classification Search
None
See application file for complete search history.

(56) References Cited

U.S. PATENT DOCUMENTS

| | | | |
|---|---|---|---|
| 9,023,649 B2 | 5/2015 | Mali et al. | |
| 9,260,723 B2 | 2/2016 | Mali et al. | |
| 2009/0007301 A1 | 1/2009 | Wintz et al. | |
| 2014/0068797 A1* | 3/2014 | Doudna | C12N 15/102 800/18 |
| 2014/0113376 A1 | 4/2014 | Sorek et al. | |
| 2014/0186958 A1 | 7/2014 | Zhang et al. | |
| 2014/0273233 A1 | 9/2014 | Chen et al. | |
| 2014/0356867 A1 | 12/2014 | Peter et al. | |
| 2014/0356956 A1 | 12/2014 | Church et al. | |
| 2015/0050699 A1 | 2/2015 | Siksnys et al. | |
| 2015/0064138 A1 | 3/2015 | Lu et al. | |
| 2015/0093473 A1 | 4/2015 | Barrangou et al. | |
| 2015/0098954 A1 | 4/2015 | Hyde et al. | |
| 2015/0132263 A1 | 5/2015 | Liu et al. | |
| 2015/0291961 A1 | 10/2015 | Siksnys et al. | |
| 2015/0315576 A1 | 11/2015 | Caliando et al. | |
| 2015/0353901 A1 | 12/2015 | Liu et al. | |
| 2016/0017366 A1 | 1/2016 | Chen et al. | |
| 2016/0024510 A1 | 1/2016 | Bikard et al. | |
| 2016/0186213 A1 | 6/2016 | Zhang et al. | |
| 2016/0289700 A1 | 10/2016 | Barrangou et al. | |
| 2016/0333348 A1 | 11/2016 | Clube et al. | |
| 2017/0002339 A1 | 1/2017 | Barrangou et al. | |
| 2017/0028083 A1 | 2/2017 | Beisel et al. | |
| 2017/0196225 A1 | 7/2017 | Clube et al. | |
| 2017/0246221 A1 | 8/2017 | Clube et al. | |

(Continued)

FOREIGN PATENT DOCUMENTS

| | | |
|---|---|---|
| EP | 286267 A1 | 4/2015 |
| WO | WO 2010/054154 | 5/2010 |

(Continued)

OTHER PUBLICATIONS

Ajdic et al., NCBI Reference Sequence: NP_721764.1, hypothetical protein SMU_1405c [*Streptococcus mutans* UA159] Direct Submission Jul. 9, 2002 (Year: 2002).*

(Continued)

*Primary Examiner* — Kevin K Hill
*Assistant Examiner* — Arthur S Leonard
(74) *Attorney, Agent, or Firm* — Myers Bigel, P.A.

(57) ABSTRACT

The present invention is directed to methods and compositions comprising novel CRISPR polypeptides and polynucleotides for site-specific cleavage and nicking of nucleic acids, transcriptional control and genome editing.

17 Claims, 28 Drawing Sheets

Specification includes a Sequence Listing.

(56) References Cited

U.S. PATENT DOCUMENTS

| | | | |
|---|---|---|---|
| 2018/0064114 A1 | 3/2018 | Clube |
| 2018/0064115 A1 | 3/2018 | Clube |
| 2018/0070594 A1 | 3/2018 | Clube |
| 2018/0084785 A1 | 3/2018 | Clube |
| 2018/0084786 A1 | 3/2018 | Clube |
| 2018/0146681 A1 | 5/2018 | Clube |
| 2018/0155729 A1 | 6/2018 | Beisel et al. |
| 2018/0273937 A1 | 9/2018 | Beisel et al. |

FOREIGN PATENT DOCUMENTS

| | | | | |
|---|---|---|---|---|
| WO | WO 2010/075424 | 7/2010 | | |
| WO | WO 2013/098244 | 7/2013 | | |
| WO | WO 2013/141680 | 9/2013 | | |
| WO | WO-2013141680 A1 * | 9/2013 | ........... | C12N 15/111 |
| WO | WO 2013/176772 | 11/2013 | | |
| WO | WO 2013/188522 | 12/2013 | | |
| WO | WO 2013/188638 | 12/2013 | | |
| WO | WO 2014/022702 | 2/2014 | | |
| WO | WO 2014/065596 | 5/2014 | | |
| WO | WO 2014/071235 | 5/2014 | | |
| WO | WO 2014/110006 | 7/2014 | | |
| WO | WO 2014/113493 | 7/2014 | | |
| WO | WO 2014/124226 | 8/2014 | | |
| WO | WO 2014/144155 | 9/2014 | | |
| WO | WO 2014/144592 | 9/2014 | | |
| WO | WO 2014/150624 | 9/2014 | | |
| WO | WO 2014/186686 | 11/2014 | | |
| WO | WO 2014/191128 | 12/2014 | | |
| WO | WO 2014/201015 | 12/2014 | | |
| WO | WO 2014/204727 | 12/2014 | | |
| WO | WO 20141191518 | 12/2014 | | |
| WO | WO 2015/021353 | 2/2015 | | |
| WO | WO 2015/026886 | 2/2015 | | |
| WO | WO 2015/034872 | 3/2015 | | |
| WO | WO 2015/035139 | 3/2015 | | |
| WO | WO 2016/040402 | 3/2015 | | |
| WO | WO 2015/053995 | 4/2015 | | |
| WO | 2015/066119 | 5/2015 | | |
| WO | WO 2015/070193 | 5/2015 | | |
| WO | WO 2015/077290 | 5/2015 | | |
| WO | 2015/089486 | 6/2015 | | |
| WO | WO 2015/089277 | 6/2015 | | |
| WO | WO 2015/089406 | 6/2015 | | |
| WO | 2015/112896 | 7/2015 | | |
| WO | WO 2015/116686 | 8/2015 | | |
| WO | WO 2015/119941 | 8/2015 | | |
| WO | WO 2015/139139 | 9/2015 | | |
| WO | 2015/159068 | 10/2015 | | |
| WO | WO 2015/148680 | 10/2015 | | |
| WO | WO 2015/153791 | 10/2015 | | |
| WO | WO 2015/153889 | 10/2015 | | |
| WO | WO 2015/153940 | 10/2015 | | |
| WO | WO 2015/155686 | 10/2015 | | |
| WO | WO 2015/159086 | 10/2015 | | |
| WO | WO 2015/159087 | 10/2015 | | |
| WO | WO 2015/160683 | 10/2015 | | |
| WO | WO 2015/189693 | 12/2015 | | |
| WO | WO 2015/200555 | 12/2015 | | |
| WO | WO 2016/084088 | 6/2016 | | |
| WO | WO 2016/177682 | 6/2016 | | |
| WO | 2016/196361 | 12/2016 | | |
| WO | 2016/205276 | 12/2016 | | |
| WO | 2017/027423 | 2/2017 | | |
| WO | 2017/058751 | 4/2017 | | |
| WO | 2017/112620 | 6/2017 | | |

OTHER PUBLICATIONS

Marcotte et al., NCBI Reference Sequence CP00683, Lactobacillus gasseri DSM 14869, Direct Submission Oct. 17, 2013 (Year: 2013).*
Claesson et al., NCBI reference sequence NC_007929, direct submission Dec. 16, 2005, p. 1. (Year: 2005).*

Cochrane Kyla et al., "Complete genome sequences and analysis of the *Fusobacterium nucleatum* subspecies *animalls* 7-1 bacteriophage PHIFunu1 and PHIFunu2", Anaerobe, 38:125-129 (2016).
Nale Janet Y. et al., "Diverse temperate bacteriophage carriage in Clostridium difficiie 027 strains", PLoS One, 7(5) 1-9 (2012).
Uchiyama Jumpei et al., "Characterization of Helicobacter pylori bacteriophage KHP30", Applied and environmental microbiolgy, 79(10):3176-3184 (2013).
Written Opinion of the International Search Report regarding International Application No. PCT/US2016/067657, dated Mar. 6, 2017, 9 pages.
Barrangou R. "CRISPR-Cas systems and RNA-guided interference", *Wiley interdisciplinary reviews, RNA* (2013) 4: pp. 267-278.
Barrangou R., et al. "CRISPR: new horizons in phage resistance and strain identification" *Annu Rev Food Sci Technol* (2012) 3, pp. 143-162.
Barrangou R., et al. "CRISPR-Cas systems: prokaryotes upgrade to adaptive immunity", *Mol Cell* (2014) 54(2): pp. 234-244.
Barrangou, R. "Diversity of CRISPR-Cas immune systems and molecular machines", *Genome Biology* (2015) 16:247, 11 pages.
Barrangou. R., et al "CRISPR provides acquired resistance against viruses in prokaryotes", *Science* (2007) 315(5819) pp. 1709-1712.
Bhaya et al. "CRISPR-Cas Systems in Bacteria and Archaea: Versatile Small RNAs for Adaptve Defense and Regulation", Annu. Rev. Genet (2011) 45: pp. 273-297.
Bikard D. et al. "Programmable repression and activation of bacterial gene expression using an engineered CRISPR-Cas system" *Nucleic Acids Res* (2013) 41(15): pp. 7429-7437.
Bikard D., et al. "CRISPR interference can prevent natural transformation and virulence acquisition during in vivo bacterial infection", *Cell Host & Microbe* (2012), 10 pages.
Bikard D., et al. "Exploiting CRISPR-Cas nucleases to produce sequence-specific antimicrobial", *Nature Biotechnology* 2014, 6 pages.
Briner AE, Barrangou R. "*Lactobacillus buchneri* Genotyping on the Basis of Clustered Regularly Interspaced Short Palindromic Repeat (CRISPR) Locus Diversity", *Appl Environ Microbiol*. 80:994-1001, (2014).
Briner et al. "Guide RNA Functional Modules Direct Cas9 Activity and Orthogonality", *Molecular Cell*. (2014) 56(2); pp. 333-339.
Brouns SJJ, et al. "Small CRISPR RNAs guide antiviral defense in prokaryotes", *Science* (2008) 321:5891; pp. 960-964.
Carte et al. "The three major types of CRISPR-Cas systems function independently in CRISPR RNA biogenesis in *Streptococcus thermophilus*", *Molecular Microbiology*, 93(1), pp. 98-112 (2014).
Chylinski et al. "Classification and evolution of type II CRISPR-Cas Systems", *Nucleic Acid Research*, (2014) 15 pages.
Chylinski Krzysztof et al., "The tracrRNA and Cas9 families of type II CRISPR-Cas immunity systems", *RNA biology*, 10:5, 13 pages (2013).
Citorik R., et al. "Sequence-specific antimicrobials using efficiently delivered RNA-guided nucleases", *Nature Biotechnology* 2014, 7 pages.
Cong et al. "Multiplex Genome Engineering Using CRISPR/Cas Systems" *Science* (2013) vol. 339 (6121); pp. 819-823.
Darmon E. Leach DF "Bacterial Genome Instability", *Microbiol. Mol. Biol.* Rev. (2014) vol. 78, pp. 1-39.
Deltcheva, E. et al. "CRISPR RNA maturation by trans-encoded small RNA and host factot RNase III" *Nature*, vol. 471, (Mar. 2011) pp. 602-607.
Doench et al, "Rational design of highly active sgRNAs for CRISPR-Cas9-mediated gene inactivation", *Nature Biotechnology*, 32:12 (2014) 8 pages.
Dupuis Mè et al., "CRISPR-Cas and restriction-modification systems are compatible and increase phage resistance", *Nat Commun.*, vol. 4, p. 2087 (2013).
Edgar R., et al. "The *Escherichia coli* CRISPR System Protects from Lysogenization, Lysogens, and Prophage Induction", *Journal of Bacteriology* (2010), vol. 192, No. 23. pp. 6292-6294.
Estvelt et al. "Orthogonal Cas9 proteins for RNA-guided gene regulation and editing", *Nature Methods*, 10:11 (2013) pp. 1116-1121.

(56) References Cited

OTHER PUBLICATIONS

Fonfara, I. et al. "Phylogeny of Cas9 determines functional exchangeability of dual-RNA an Cas9 among orthologous type II CRISPR-Cas systems"; *Nucleic Acids Res* (2013) 14 pages.
Fu et al. "Improving CRISPR-Cas nuclease specificity using truncated guide RNAs", *Nature Biotechnology*, 32:3 (2013) 9 pages.
Garneau JE, et al. "The CRISPR/Cas bacterial immune system cleaves bacteriophage and piasmid DNA" *Nature* (2010) 468(7320): pp. 67-71.
Gasiunas et al. "Cas9-crRNA ribonucleoprotein complex mediates specific DNA cleavage for adaptive immunity in bacteria", *Proc. Natl. Acad. Sci.* (2012) 109:E2579-E2586.
Gilbert et al. "Genome-Scale CRISPR-Mediated Control of Gene Repression and Activation", *Cell*, 159 (2014) pp. 647-661.
Gilbert, L. A. et al. "CRISPR-Mediated Modular RNA-Guided Regulation of Transcription in Eukaryotes", *Cell 154*,(2013) pp. 442-451.
Gomaa AA, et al. "Programmable Removal of Bacterial Strains by Use of Genome-Targeting CRISPR-Cas Systems", *mBio* (2014), 5(1):e00928-13.
Haurwitz et al. "Sequence- and Structure-Specific RNA Processing by a CRISPR Endonuolease", *Science* (2010) 329: pp. 1355-1358.
Horvath and Barrangou "CRISPR/Cas, the Immune System of Bacteria and Archaea", *Science* (2010) 327, pp. 167-170.
Horvath, P. et al. "Diversity, Activity, and Evolution of CRISPR Loci in *Streptococcus thermophilus*", *J Bacteriol.* 190 (2008) pp. 1401-1412.
Hsu et al. "DNA targeting specificity of RNA-guided Cas9 nucleases", *Nature Biotehnology*, 31:9 (2013) pp. 827-834.
Jiang, W. et al. "Dealing with the Evolutionary Downside of CRISPR Immunity: Bacteria and Beneficial Plasmids", *PLOS Genetics* (2013) vol. 9, issue 9, 13 pages.
Jiang, W. et al. "RNA-guided editing of bacterial genomes using CRISPR-Cas systems", *Nat. Biotechnol.* (2013) vol. 31, pp. 233-239.
Jinek et al. "A Programmable Dual-RNA-Guided DNA Endonuclease in Adaptive Bacterial Immunity", *Science* (2012) vol. 337, pp. 816-821.
Jinek, M. et al.,"Structures of Cas9 endonucleases reveal RNA-mediated conformational activation", *Science* (2014) vol. 343, 6176, 28 pages.
Karvelis et al. "crRNA and tracrRNA guide Cas9-mediated DNA interference in *Streptococcus thermophilus*", *RNA Biol.* (2013) vol. 10: pp. 841-851.
Kobayashi K, et al. "Essential *Bacillus subtilis* genes", *Proc. Natl. Acad. Sci.* U.S.A. (2003) vol. 100, pp. 4678-4683.
Labrie SJ et al. "Bacteriophage resistance mechanisms" *Nat. Rev. Microbiol.* (2010) vol. 8, pp. 317-327.
Luo, M. et al., "Repurposing endogenous type I CRISPR-Cas systems for programmable gene repression", *Nucleic Acid Research* (2014) 8 pages.
Magadan et al. "Cleavage of Phage DNA by the *Streptococcus thermophilus* CRISPR3-Cas System": *PLoS One* (2012) 7:e40913. 8 pages.
Mahillon J. et al. "Insertion sequences", *Microbiol Mol Biol Rev* (1998) vol. 62(3): pp. 725-774.
Makarova and Koonin "Annotation and Classification of CRISPR-Cas Systems", *Methods Mol Biol.* (2015), 1311: pp. 47-75.
Makarova et al. "An updated evolutionary classification of CRISPR-Cas systems", *Net Rev Microbiol* 13:722-736 (2015), 15 pages.
Makarova et al. "Unification of Cas protein families and a simple scenario for the origin and evolution of CRISPRCas systems", *Biol Direct.* (2011) vol. 6:38, 27 pages.
Makarova, K. S. et al. "Evolution and classification of the CRISPR-Cas systems", *Nat Rev Microbiol* (2011) vol. 9, pp. 467-477.
Marraffini and Sontheimer "CRISPR Interference Limits Horizontal Gene Transfer in *Staphylococci* by Targeting DNA", *Science* (2008) vol. 322 pp. 1843-1845.

Mojica, F. et al. "Short motif sequences determine the targets of the prokaryotic CRISPR defence system", *Microbiology* (2009) vol. 155, 8 pages.
Nishimasu, H., et al. "Crystal Structure of Cas9 in Complex with Guide RNA and Target DNA", *Cell* (2014) vol. 156, pp. 935-949.
Notification of International Preliminary Report on Patentability corresponding to International Application No. PCT/IB2015/052515; dated Oct. 12, 2016, 7 pages.
Notification and Transmittal of International Search Report and Written Opinion of the International Searching Authority for International Application No. PCT/IB2015/052515; dated Oct. 10, 2015; 12 pages.
Notification of Transmittal of the International Search Report and the Written Opinion of the International Searching Authority, or the Declaration, PCT/US2016/034812, dated Sep. 15, 2016, 9 pages.
Novagen "pCDF-1b Vector" Sep. 10, 2003, Retrieved from the Internet on Sep. 1, 2015, at http://www.helmholtz-muenchen.de/fieadmin/PEPF/pCDF_vectors/pCDF-1b_map.pdf, 2 pages.
Oh JH and van Pijkeren JP "CRISPR-Cas9-assisted recombineering in *Lactobacillus reuteri*", *Nucleic Acids Res* (2014) vol. 10.1093/nar/gku623.
Qi, L. S. et al. "Repurposing CRISPR as an RNA-Guided Platform for Sequence-Specific Control of Gene Expression". *Cell* 152, 1173-1183 (2013), 11 pages.
Sander JD, and Joung JK. "CRISPR-Cas systems for editing, regulating and targeting genomes", *Nat. Biotechnol.* (2014) vol. 32, pp. 347-355.
Sapranauskas et al. "The *Streptococcus thermophilus* CRISPR/Cas system provides immunity in *Escherichia coil*", *Nucleic Acid Res.* (2011) vol. 39: pp. 9275-9282.
Seed Kimberley D. et al., "A bacteriophage encodes its own CRISPR/Cas adaptive response to evade host innate immunity", *Nature*, 494:7438, pp. 489-491.
Selle K, Barrangou R. "Harnessing CRISPR-Cas systems for bacterial genome editing", *Cell Press: Trends Microbiol.* (2015) vol. 23(4): pp. 225-232.
Selle, K. et al. "CRISPR-based screening of genomic island excision events in bacteria", *Prot Natl Acad Sci USA*, (2015): 112(26): pp. 8076-8081.
Selle, K. et al., "CRISPR-Based Technciogies and the Future of Food Science", *Journal of Food Science* (2015) vol. 80, 6 pages.
Semenova et al. "Interference by clustered regularly interspaced short palindromic repeat (CRISPR) RNA is governed by a seed sequence", *PNAS*, 108:25 (2011) 6 pages.
Sinkuna, T. et al. "In vitro reconstitution of Cascade-mediated CRISPR immunity in *Streptococcus thermophilus*", *The EMBO Journal* (2013) vol. 32, pp. 385-394.
Stern, A. et al., "Self-targeting by CRISPR: gene regulation or autoimmunity", *Cell Press: Trends in Genetics*, (2010) vol. 26, No. 8, 6 pages.
Sternberg et al. "DNA interrogation by the CRISPR RNA-guided endonuclease Cas9", *Nature*, vol. 507, (2014) 17 pages.
Terns and Terns "CRISPR-based adaptive immune systems", *Curr. Opin. Microbiol.* (2011) vol. 14: pp. 321-327.
Vercoe RB et al. "Cytotoxic chromosomal targeting by CRISPR/Cas systems reshape bacterial genomes and expel or remodel pathogenicity islands", *PLoS Genet* (2013) vol. 9(4):e1003454.
Westra et al. "The CRISPRs, They Are A-Changin': How Prokaryotes Generate Adaptive Immunity", *Annu. Rev. Genet.* (2012) vol. 46: pp. 311-339.
Wiedenheft et al. "RNA-guided complex from a bacterial immune system enhances target recognition through seed sequence interactions", *PNAS*, 108:36 (2011) 7 pages.
Written Opinion and International Search Report corresponding to International Application No. PCT/US2016/037493, dated Sep. 15. 2016, 8 pages.
Tautvydas Karvelis et al., "crRNA and tracerRNK guide Cas9-mediated DNA interference in *Streptococcus thermophilius*," RNA Biology, 2013, vol. 10, Issue 5, pp. 841-851.
Karvelis Tautvydas et al., "Programmable DNA cleavage in vitro by Cas9," Biochem. Soc. Trans. 2013, vol. 41, part 6, pp. 1401-1406.
International Search Report and Written Opinion for PCT/US2015/047136 dated Nov. 26, 2015, 10 pages.

(56) References Cited

OTHER PUBLICATIONS

Ajdic et al. "hypothetical protein SMU_1405c [*Streptococcus mutans* UA159]", Proc. Natl. Acad. Sci. U.S.A. 99 (22), 14434-14439 (2002) URL: https://www.ncbi.nlm.nih.gov/protein/NP_721764.1/, retrieved Jul. 20, 2018.

Marcotte H. et al. "Proteomes—Lactobacillus gasseri DSM 14869", NCBI Reference Sequence CP006803, (2013) URL: http://www.uniprot.org/proteomes/UP000217220, retrieved Jul. 20, 2018.

Ramakrishna Suresh et al. "Gene disruption by cell-penetrating peptide-mediated delivery of Cas9 protein and guide RNA", Genome Research, 24:1020-1027 (2014).

Heinl, Stefan et al. "Insights into the completely annotated genome of Lactobacillus buchneri CD034, a strain isolated from stable grass silage", Journal of Biotechnology, 161:153-166 (2012).

Beisel CL et al. A CRISPR design for next-generation antimicrobials. Genome Biology. 2014; 15: 516, 4 pages.

Citorik RJ et al. "Sequence-specific antimicrobials using efficiently delivered RNA-guiding nucleases Supplemental Material." Nature Biotechnology. Sep. 21, 2014; 32(11); 1141-1145. DOI:10.1038./nbt.3011, 14 pages.

Final Office Action, U.S. Appl. No. 15/113,656, dated Jul. 30, 2013, 8 pages.

Liu S et al. Complete genome sequence of Lactobacillus buchneri NRRL B-30929, a novel strain from a commercial ethanol plant, Journal of Bacteriology. Aug. 2011: 193(15): 4010-4020.

Liu S et al. NCBI (2011) CRISPR-associated protein, Csn1 family [Lactobacillus buchneri], pp. 1-3.

International Search Report and Written Opinion, PCT/US2018/034322, dated Sep. 13, 2018, 7 pages.

Final Office Action, U.S. Appl. No. 15/302,655, dated Nov. 2, 2018, 21 pages.

Milani C et al. Genomic encyclopedia of type strains of the genus *Bifidobacterium*. Applied and Environmental Microbiology. Oct. 2014; 80(20): 6290-6302.

Database GenBank [online]. NBI, U.S. National Library of Medicine. Aug. 5, 2014. "CRISPER-associated protein, Csn1 family [Bifidobacterium bombi DSM 19703]" XP002785852, retrieved from NCBI accession No. GenBank: KFF31259. Database accession No. KFF312559. 1 page.

\* cited by examiner

| | |
|---|---|
| S. pyogenes | AAGGC---------UA--------GUCCGU |
| S. dysagalactiae | AAGGC---------UA--------GUCCGU |
| S. equi | AAGGCU--------UU--------GUCCGU |
| S. thermophilus CRISPR3 | AAGGCU--------UA--------GUCCGU |
| S. salivarius | AAGGCU--------UA--------GUCCGU |
| S. gallolyticus | AAGGCU--------UU--------GUCCGU |
| S. lutetiensis | AAGGCU--------UU--------GUCCGU |
| S. anginosus A | AAGGCU--------UU--------GUCCGU |
| S. mitis | AAGGCU--------UU--------GUCCGU |
| S. sanguinis | AAGGCU--------UU--------GUCCGU |
| S. oralis | AAGGCU--------UU--------GUCCGU |
| S. mutans | AAGGCU--------UC--------AUGCCG |
| S. intermedius | AAGGCU--------UC--------AUGCCG |
| S. anginosus B | AAGGCU--------UC--------AUGCCG |
| S. thermophilus CRISPR1 | AAGGCU--------UC--------AUGCCG |
| S. vestibularis | AAGGCU--------UC--------AUGCCG |
| S. gordonii | AAGGCU--------UC--------AUGCCG |
| S. parasanguinis | AAGGCU--------UC--------AUGCCG |
| S. orisratti | AAGGCU--------UC--------AUGCCG |
| S. henryi | AAGGCU--------UC--------AUGCCG |
| S. infantarius | AAGGCU--------UC--------AUGCCG |
| L. brevis | CAACAAGGCA--GUAA--UGCCAAGUUC |
| L. buchneri A | CAACAAGGUA--GCAA--UACCAAGUUC |
| L. mucosae | CAACAAUGCA--UUC---UGCAAAGUUA |
| L. curvatus | CAACAAGGUC--UUCG--GACCAAGUUU |
| L. fermentum | CAACGAGUGG--UUUU--CCACGAGUUA |
| L. reuteri | CAACAAGUGC--UUCA--GCACAAGUUU |
| L. plantarum | CAACAAGGCA--UUU---UGCCAAGUUU |
| L. pentosus | CAACAAGGCA--UUU---UGCCGAGUUU |
| L. coryniformis | CAACAAGGC---GUAA---GCCAAGUUU |
| L. buchneri B | CAAGCAAAGGCA-UUU--GCGCGGAGUUU |
| L. otakiensis | CAAGCAAUGCGC-UUU--GCGCGGAGUUU |
| L. paracasei | CAACAAAGCC---UC---GGCUGAGUUU |
| L. casei | CAACAAAGCC---UC---GGCUGAGUUU |
| L. rhamnosus | CAACAAAGCU---UC---AGCUGAGUUU |
| L. gasseri | CAAGCAAUGCAUCUUUUGAUGCAAAGUUU |
| L. hominis | CAAGCAAUGCAUCUUUUGAUGCAAAGUUU |
| L. johnsonii | CAAGCAAUGCAUCUUUUGAUGCAAAGUUU |
| L. jensenii | CAAGCAAGGCU--UUCG--GGCCGAGUUU |
| L. delbrueckii | CAAGCAAGCUC-UUCG-GAGCGGAGUUU |
| L. rossiae | CAAGCAAGGCU--UUCG-AGCCAAGUUU |

FIG. 4

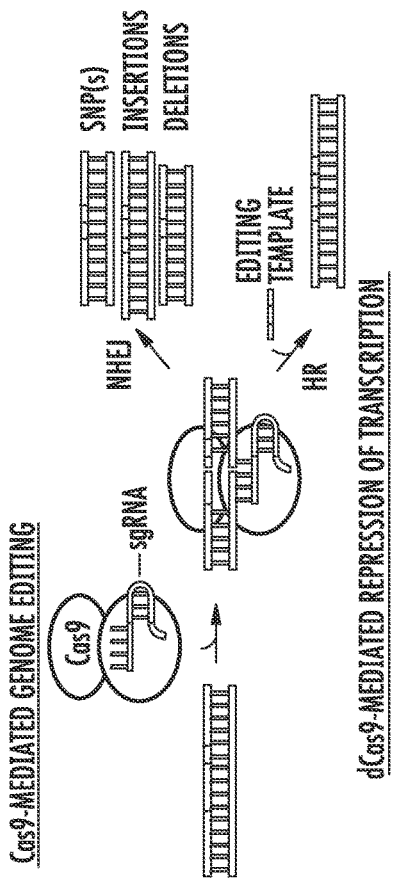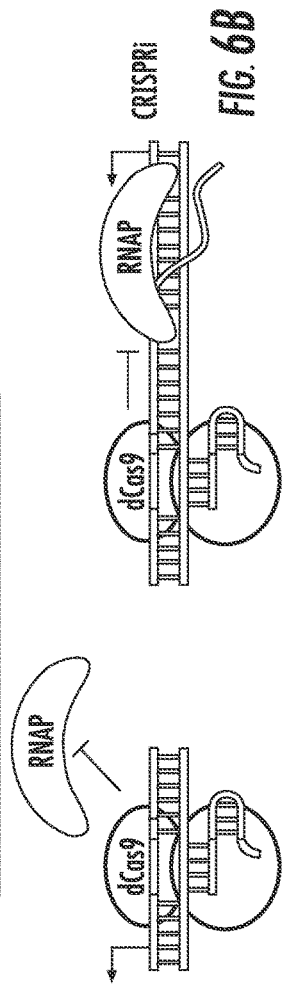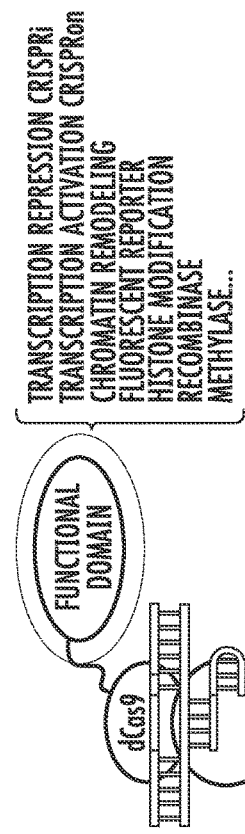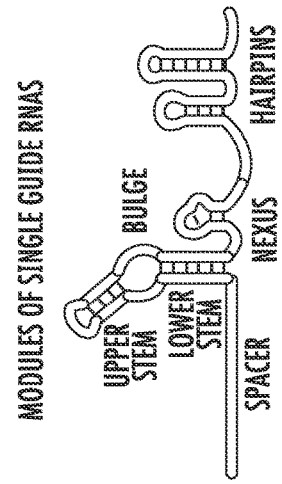
FIG. 6A
FIG. 6B
FIG. 6C

US 10,450,584 B2

CAS9 PROTEINS AND GUIDING FEATURES FOR DNA TARGETING AND GENOME EDITING

STATEMENT OF PRIORITY

This application is a 35 U.S.C. § 371 national phase application of International Application Serial No. PCT/US2015/047136, filed Aug. 27, 2015, which claims the claims the benefit, under 35 U.S.C. § 119(e), of U.S. Provisional Application No. 62/043,882 filed Aug. 29, 2014 and U.S. Provisional Application No. 62/043,204 filed Aug. 28, 2014, the entire contents of each of which is incorporated by reference herein.

STATEMENT REGARDING ELECTRONIC FILING OF A SEQUENCE LISTING

A Sequence Listing in ASCII text format, submitted under 37 C.F.R. § 1.821, entitled 5051-869PR_ST25.txt, 1,678, 777 bytes in size, generated on Aug. 8, 2018 and filed via EFS-Web, is provided in lieu of a paper copy. This Sequence Listing is hereby incorporated herein by reference into the specification for its disclosures.

FIELD OF THE INVENTION

The invention relates to synthetic CRISPR-cas systems and methods of use thereof for site-specific cleavage and nicking, transcriptional control and genome editing.

BACKGROUND OF THE INVENTION

Clustered Regularly interspaced Short Palindromic Repeats (CRISPR), in combination with associated sequences (cas) constitute the CRISPR-Cas system, which confers adaptive immunity in many bacteria. CRISPR-mediated immunization occurs through the uptake of DNA from invasive genetic elements such as plasmids and phages, as novel "spacers."

CRISPR-Cas systems consist of arrays of short DNA repeats interspaced by hypervariable sequences, flanked by cas genes, that provide adaptive immunity against invasive genetic elements such as phage and plasmids, through sequence-specific targeting and interference (Barrangou et al. 2007. *Science*. 315:1709-1712; Brouns et al. 2008. *Science* 321:960-4; Horvath and Barrangou. 2010. *Science*. 327:167-70; Marraffini and Sontheimer. 2008. *Science*. 322:1843-1845; Bhaya et al. 2011. *Anna. Rev. Genet*. 45:273-297; Terns and Terns. 2011. *Curr. Opin. Microbiol*. 14:321-327; Westra et al. 2012. *Anna. Rev. Genet*. 46:311-339; Barrangou R. 2013. *RNA*. 4:267-278). Typically, invasive DNA sequences are acquired as novel "spacers" (Barrangou et al. 2007. *Science*. 315:1709-1712), each paired with a CRISPR repeat and inserted as a novel repeat-spacer unit in the CRISPR locus. Subsequently, the repeat-spacer array is transcribed as a long pre-CRISPR RNA (pre-crRNA) (Brouns et al. 2008. *Science* 321:960-4), which is processed into small interfering CRISPR RNAs (crRNAs) that drive sequence-specific recognition. Specifically, crRNAs guide nucleases towards complementary targets for sequence-specific nucleic acid cleavage mediated by Cas endonucleases (Garneau et al. 2010. *Nature*. 468:67-71; Haurwitz et al. 2010. *Science*. 329:1355-1358; Sapranauskas et al. 2011. *Nucleic Acid Res*. 39:9275-9282; Jinek et al. 2012. *Science*. 337:816-821; Gasiunas et al. 2012. *Proc. Natl. Acad. Sci.* 109:E2579-E2586; Magadan et al. 2012. *PLoS One*. 7:e40913; Karvelis et al. 2013. *RNA Biol*. 10:841-851). These widespread systems occur in nearly half of bacteria (~46%) and the large majority of archaea (~90%). They are classified into three main CRISPR-Cas systems types (Makarova et al. 2011. *Nature Rev. Microbiol*. 9:467-477; Makarova et al. 2013. *Nucleic Acid Res*. 41:4360-4377) based on the cas gene content, organization and variation in the biochemical processes that drive crRNA biogenesis, and Cas protein complexes that mediate target recognition and cleavage. In types I and III, the specialized Cas endonucleases process the pre-crRNAs, which then assemble into a large multi-Cas protein complex capable of recognizing and cleaving nucleic acids complementary to the crRNA. A different process is involved in Type II CRISPR-Cas systems. Here, the pre-CRNAs are processed by a mechanism in which a trans-activating crRNA (tracrRNA) hybridizes to repeat regions of the crRNA. The hybridized crRNA-tracrRNA are cleaved by RNase III and following a second event that removes the 5' end of each spacer, mature crRNAs are produced that remain associated with the both the tracrRNA and Cas9. The mature complex then locates a target dsDNA sequence ('protospacer' sequence) that is complementary to the spacer sequence in the complex and cuts both strands. Target recognition and cleavage by the complex in the type II system not only requires a sequence that is complementary between the spacer sequence on the crRNA-tracrRNA complex and the target 'protospacer' sequence but also requires a protospacer adjacent motif (PAM) sequence located at the 3' end of the protospacer sequence. The exact PAM sequence that is required can vary between different type II systems.

The present disclosure provides methods and compositions for increasing the efficiency and specificity of synthetic type II CRISPR-Cas systems in such uses as, for example, site-specific cleavage, site-specific nicking, transcriptional control and genome editing.

SUMMARY OF THE INVENTION

In some embodiments of the invention a protein-RNA complex is provide, the complex comprising the following components: (a) a Cas9 polypeptide comprising the amino acid sequence having at least about 80% identity to a polypeptide comprising an amino acid sequence of any of SEQ ID NOs:194-293, or a functional fragment thereof; (b) a crRNA comprising a 3' region and a 5' region, wherein the 3' region comprises at least about 10 consecutive nucleotides of a Clustered Regularly Interspaced Short Palindromic Repeat (CRISPR) repeat comprising a nucleotide sequence of any one of the nucleotide sequences of SEQ NOs:1-98, or a functional fragment thereof, and the 5' region comprises at least about 10 consecutive nucleotides of a spacer sequence located upstream of the repeat; and (c) a tracrRNA comprising a 5' and 3' region wherein at least a portion of the 5' region of the tracrRNA is complementary to the 3' region (CRISPR repeat) of the crRNA.

In other embodiments, the invention provides a chimeric RNA construct comprising: (a) a crRNA comprising a 3' region and a 5' region, wherein the 3' region comprises at least about 10 consecutive nucleotides of a CRISPR repeat comprising a nucleotide sequence of any one of the nucleotide sequences of SEQ ID NOs:1-98, or a functional fragment thereof, and the 5' region comprises at least about 10 consecutive nucleotides of a spacer sequence located immediately upstream of the repeat, and (b) a tracrRNA comprising a 5' and 3' region, wherein at least a portion of the 5' region of the tracrRNA is complementary to the 3' region (CRISPR repeat) of the crRNA and the 3' region of said tracrRNA forms secondary structures In further embodiments, a method for site specific cleavage of a target DNA is provided, the method comprising: contacting a complex of the invention with the target DNA, thereby producing a site specific cleavage of the target DNA in a region defined by complementary binding of the spacer sequence of the crRNA to the target nucleic acid In still further embodiments, a method for site specific cleavage of a target DNA is provided, the method comprising: contacting a chimeric RNA of the invention with the target DNA in the presence of a Cas9 polypeptide, thereby producing a site specific cleavage of the target nucleic acid in a region defined by complementary binding of the spacer sequence of the crRNA to the target DNA.

In some embodiments, the invention provides a method of transcriptional control of a target DNA, comprising: contacting a complex of the invention with the target DNA, wherein the complex binds to the target DNA and the Cas9 polypeptide of the complex is deactivated, thereby controlling the transcription of the target DNA. In some embodiments, the invention provides a method of transcriptional control of a target DNA, comprising: contacting a chimeric RNA of the invention with the target DNA in the presence of an deactivated Cas9 polypeptide, wherein the chimeric RNA binds to the target DNA, thereby controlling the transcription of the target DNA. In some embodiments, the deactivated Cas9 polypeptide is fused with a transcriptional activator, thereby activating transcription of the target DNA.

In other embodiments, a method of DNA editing is provided, the method comprising: contacting a complex of the present invention with the target DNA, wherein the complex binds to the target DNA, thereby editing the target DNA.

In still other embodiments, a method of DNA editing is provided, the method comprising: contacting a chimeric RNA of the invention with the target DNA in the presence of a Cas9 polypeptide, wherein the chimeric RNA binds to the target DNA, thereby editing the target DNA.

In additional embodiments, a method for cleaving a double stranded polynucleotide is provided, comprising contacting a complex of the invention with said polynucleotide, wherein the polynucleotide comprises: (a) a protospacer sequence comprising a sequence that is least 80% complementary to the spacer sequence in the crRNA in said complex, and (b) a protospacer adjacent motif (PAM) comprising a nucleotide sequence of any one of the nucleotide sequences of 5'-NGG-3', 5'-NGAAA-3', 5'-NNG-3', 5'-NGA-3', 5'-NTAA-3', 5'-NTG-3', 5'-NNC-3', 5'-NNAAC-3', 5'-AGA-3', 5'-NNNANNA-3', 5'-NNANAA-3', 5'-NNAAAA-3', and/or 5'-AAAA-3' downstream from the protospacer sequence.

In some embodiments, a method for site specific cleavage of a target DNA is provided, comprising: contacting a CRISPR RNA (crRNA) and a trans-encoded CRISPR RNA (tracrRNA) with the target DNA in the presence of a Cas9 polypeptide, wherein (a) the crRNA comprises at its 3' region a repeat from *Lactobacillus* spp., *Bifidobacterium* spp., *Kandleria* spp., *Leuconostoc* spp., *Oenococcus* spp., *Pediococcus* spp., *Streptococcus* spp., *Weissella* spp., and/or *Olsenella* spp., and at its 5' region a spacer sequence from the target DNA, (b) the tracrRNA comprises a sequence at its 5' region that is complementary to the repeat of the crRNA, and (c) the spacer sequence hybridizes with a portion of the target DNA that is complementary to the spacer sequence and adjacent to a protospacer adjacent motif (PAM) comprising the nucleotide sequence of any one of the nucleotide sequences of 5'-NGG-3', 5'-NGAAA-3', 5'-NNG-3', 5'-NGA-3', 5'-NTAA-3', 5'-NTG-3', 5'-NNC-3', 5'-NNAAC-3', 5'-AGA-3', 5'-NNNANNA-3', 5'-NNANAA-3', 5'-NNAAAA-3', and/or 5'-AAAA-3', thereby resulting in a site specific cleavage of the target DNA in the region defined by the complementary binding of the spacer sequence of the crRNA to the target DNA. In some embodiments, the crRNA comprises a nucleotide sequence of any one of the nucleotide sequences of SEQ ID NOs:1-98, or a functional fragment thereof, the tracrRNA comprises a nucleotide sequence of any one of the nucleotide sequences of SEQ ID NOs:99-193, or a functional fragment thereof, and the Cas9 polypeptide is from *Lactobacillus* spp., *Bifidobacterium* spp., *Kandleria* spp., *Leuconostoc* spp., *Oenococcus* spp., *Pediococcus* spp., *Streptococcus* spp., *Weissella* spp., and/or *Olsenella* spp. In some embodiments, the Cas9 polypeptide comprises an amino acid sequence having at least about 80% identity to a polypeptide comprising the amino acid sequence of any one of SEQ ID NOs:194-293, or a functional fragment thereof.

In further embodiments, a method for site-specific nicking of a (+) strand of a double stranded target DNA is provided, the method comprising contacting a protein-RNA complex with a double stranded target DNA, wherein the complex comprises (a) a crRNA comprising a 3' region and a 5' region, wherein the 3' region comprises at least about 10 consecutive nucleotides of a CRISPR repeat from *Lactobacillus* spp., *Bifidobacterium* spp., *Kandleria* spp., *Leuconostoc* spp., *Oenococcus* spp., *Pediococcus* spp., *Streptococcus* spp., *Weissella* spp., and/or *Olsenella* spp., and the 5' region comprises at least about 10 consecutive nucleotides of a spacer sequence located upstream of the repeat, (b) a tracrRNA comprising a 5' and 3' region wherein at least a portion of the 5' region of the tracrRNA is complementary to the 3' region (repeat) of the crRNA, and (c) a polypeptide comprising the amino acid sequence of any one of SEQ ID NOs:194-293, or a functional fragment thereof, and comprising a point mutation in a RuvC active site motif; and the target DNA comprises a protospacer sequence that is at least about 80% complementary to the spacer sequence in the crRNA and a protospacer adjacent motif (PAM) sequence of any one of the nucleotide sequences of 5'-NGG-3', 5'-NGAAA-3', 5'-NNG-3', 5'-NGA-3', 5'-NTAA-3', 5'-NTG-3', 5'-NNC-3', 5'-NNAAC-'', 5'-AGA-3', 5'-NNNANNA-3', 5'-NNANAA-3', 5'-NNAAAA-3', and/or 5'-AAAA-3', downstream from the proto-spacer sequence, wherein the polypeptide cleaves the (+) strand of the double stranded DNA at a cleavage site located 5 nucleotides upstream of the PAM sequence, thereby producing a site-specific nick in said double stranded target DNA.

In additional embodiments, the invention provides a method for site-specific nicking of the (−) strand of a double stranded target DNA, comprising contacting a protein-RNA complex with a double stranded target DNA, wherein the complex comprises: (a) a crRNA comprising a 3' region and a 5' region, wherein the 3' region comprises at least about 10 consecutive nucleotides of a CRISPR repeat from a *Lactobacillus* spp., *Bifidobacterium* spp., *Kandleria* spp., *Leuconostoc* spp., *Oenococcus* spp., *Pediococcus* spp., *Streptococcus* spp., *Weissella* spp., and/or *Olsenella* spp., and the 5' region comprises at least about 10 consecutive nucleotides of a spacer sequence located upstream of the repeat, (b) a tracrRNA comprising a 5' and 3' region wherein at least a portion of the 5' region of the tracrRNA is complementary to the 3' region (repeat) of the crRNA, and (c) a polypeptide comprising the amino acid sequence of any one of SEQ ID NOs:194-293, or a functional fragment thereof, and comprising a point mutation in an HNH active site motif; and the target DNA comprises a protospacer sequence that is at least about 80% complementary to the spacer sequence in the crRNA and a protospacer adjacent motif (PAM) sequence comprising a nucleotide sequence of any one of the nucleotide sequences of 5'-NGG-3', 5'-NGAAA-3', 5'-NNG-3', 5'-NGA-3', 5'-NTAA-3', 5'-NTG-3', 5'-NNC-3', 5'-NNAAC-3', 5'-AGA-3', 5'-NNNANNA-3', 5'-NNANAA-3', 5'-NNAAAA-3', and/or 5'-AAAA-3' downstream from the proto-spacer sequence, wherein the polypeptide cleaves the (−) strand of the double stranded DNA at a cleavage site located 5 nucleotides upstream of the PAM sequence resulting in site-specific nicking of the target DNA. In some embodiments, the CRISPR repeat comprises a nucleotide sequence of any one of the nucleotide sequences of SEQ ID NOs:1-98, or a functional fragment thereof, and/or the tracrRNA comprises a nucleotide sequence of any one of the nucleotide sequences of SEQ ID NOs:99-193, or a functional fragment thereof.

In further embodiments, a method for site-specific cleavage of a target DNA in an organism is provided, the method comprising: introducing a protein-RNA complex into said organism or at least one cell of said organism, wherein the protein-RNA complex comprises a crRNA comprising in its 3' region a repeat from *Lactobacillus* spp., *Bifidobacterium* spp., *Kandleria* spp., *Leuconostoc* spp., *Oenococcus* spp., *Pediococcus* spp., *Streptococcus* spp., *Weissella* spp., and/or *Olsenella* spp., and in its 5' region a spacer sequence having complementarity to a site in the target DNA in which a modification is desired; a polypeptide having at least about 80% identity with a Cas9 polypeptide of *Lactobacillus* spp., *Bifidobacterium* spp., *Kandleria* spp., *Leuconostoc* spp., *Oenococcus* spp., *Pediococcus* spp., *Streptococcus* spp., *Weissella* spp., or *Olsenella* spp., and a tracrRNA comprising a sequence at its 5' region that is complementary sequence to the repeat of the crRNA, thereby producing a site-specific cleavage of the target DNA molecule in a region that is determined by the complementary spacer sequence of the crRNA to the target DNA molecule. In some embodiments, the polypeptide having at least about 80% identity with a Cas9 polypeptide comprises a polypeptide comprising the amino acid sequences of any of SEQ ID NOs:194-293, or a functional fragment thereof, the crRNA comprises a nucleotide sequence of any one of the nucleotide sequences of SEQ ID NOs:1-98, or a functional fragment thereof, and/or the tracrRNA comprises a nucleotide sequence of any one of the nucleotide sequences of SEQ ID NOs:99-193, or a functional fragment thereof.

In additional embodiments, a method of typing a bacterial strain in a sample is provided, the method comprising amplifying a region of DNA comprising repetitive sequences that are at least about 80% identical to a repetitive sequence encoded by a nucleotide sequence of any one of the nucleotide sequences of SEQ ID NOs:1-98, or a functional fragment thereof, in said sample to produce amplified DNA; and typing the bacterial strain based on the amplified DNA.

In additional embodiments, the invention provides a method of detecting the presence of a *Lactobacillus* spp., *Bifidobacterium* spp., *Kandleria* spp., *Leuconostoc* spp., *Oenococcus* spp., *Pediococcus* spp., *Streptococcus* spp., *Weissella* spp., and/or *Olsenella* spp., in a sample, comprising: amplifying in said sample a region of DNA comprising repetitive sequences that are at least about 80% identical to the repetitive sequence encoded by a nucleotide sequence of any of the nucleotide sequences of SEQ ID NOs:1-98, or a functional fragment thereof, to produce amplified DNA, and detecting the amplified DNA.

In a further embodiment, the invention provides a method of identifying a strain of *Lactobacillus* spp., *Bifidobacterium* spp., *Kandleria* spp., *Leuconostoc* spp., *Oenococcus* spp., *Pediococcus* spp., *Streptococcus* spp., *Weissella* spp., and/or *Olsenella* spp., having resistance to an invasive foreign DNA, comprising: detecting a CRISPR spacer in said strain of *Lactobacillus* spp., *Bifidobacterium* spp., *Kandleria* spp., *Leuconostoc* spp., *Oenococcus* spp., *Pediococcus* spp., *Streptococcus* spp., *Weissella* spp., and/or *Olsenella* spp., wherein said CRISPR spacer is correlated with resistance to said invasive foreign DNA (e.g., phage DNA, plasmid DNA, chromosomal DNA, transposon) in *Lactobacillus* spp., *Bifidobacterium* spp., *Kandleria* spp., *Leuconostoc* spp., *Oenococcus* spp., *Pediococcus* spp., *Streptococcus* spp., *Weissella* spp., and/or *Olsenella* spp., thereby identifying said strain as comprising said CRISPR spacer and having resistance to said invasive foreign DNA. In some embodiments, the method comprises correlating the presence of a CRISPR spacer with resistance to said invasive foreign DNA (e.g., phage DNA, plasmid DNA, chromosomal DNA, transposon) in *Lactobacillus* spp., *Bifidobacterium* spp., *Kandleria* spp., *Leuconostoc* spp., *Oenococcus* spp., *Pediococcus* spp., *Streptococcus* spp., *Weissella* spp., and/or *Olsenella* spp. having a CRISPR system. In some embodiments, the method further comprises amplifying the DNA of said strain of *Lactobacillus* spp., *Bifidobacterium* spp., *Kandleria* spp., *Leuconostoc* spp., *Oenococcus* spp., *Pediococcus* spp., *Streptococcus* spp., *Weissella* spp., and/or *Olsenella* spp. using amplification primers for amplifying the CRISPR spacer correlated with resistance, thereby producing a CRISPR spacer amplicon when said CRISPR spacer is present, thereby detecting the presence or absence of said CRISPR spacer amplicon.

In still further embodiments, the invention provides a method for modifying (conferring or increasing) resistance of a bacterium or an archaeon to an invasive foreign DNA, comprising: introducing into said bacterium or archaeon a heterologous nucleic acid molecule comprising a first and a second CRISPR repeat from *Lactobacillus* spp., *Bifidobacterium* spp., *Kandleria* spp., *Leuconostoc* spp., *Oenococcus* spp., *Pediococcus* spp., *Streptococcus* spp., *Weissella* spp., and/or *Olsenella* spp. and a CRISPR spacer, wherein the spacer is homologous to at least a portion of the invasive foreign DNA and is located 3' of the first CRISPR repeat and 5' of the second CRISPR repeat to produce transformed bacterial or archaeon cells, and selecting transformed bacteria or archaeon cells having modified resistance to said invasive foreign DNA.

The invention further provides expression cassettes, vectors and cells comprising the nucleotide sequences of this invention.

These and other aspects of the invention are set forth in more detail in the description of the invention below.

BRIEF DESCRIPTION OF THE DRAWINGS

FIG. 4 shows CRISPR repeats sequence alignment. For each cluster, CRISPR repeat sequence alignments are shown, with conserved and consensus nucleotides specified at the bottom of each family, with Sth3 (top; SEQ ID NOs:444-446), Sth1 (middle; SEQ ID NO:447) and Lb (bottom; SEQ ID NOs:448-464)

FIGS. 6A-6C provide cartoons depicting genome editing (FIG. 6A), deactivated Cas9 (dCas9)-mediated repression of transcription (FIG. 6B) and use of dCas9 as a RNA-guided DNA binding protein with additional functions (FIG. 6C). NHEJ refers to non-homologous end-joining and HDR refers to homology-directed repair.

FIG. 12A shows a phylogenetic tree based on Cas9 protein sequences from various *Streptococcus* and *Lactobacillus* species. The sequences clustered into three families. FIG. 12B shows a consensus sequence and secondary structure of the predicted guide RNA for each family. Each consensus RNA is composed of the crRNA (left; SEQ ID NOs:465-467) base-paired with the tracrRNA (SEQ ID NOs:468-471). Fully conserved bases are in lighter text, variable bases are in black (2 possible bases) or represented by black dots (at least 3 possible bases), and base positions not always present are circled. Circles between positions indicate base pairing present in only some family members.

DETAILED DESCRIPTION OF THE INVENTION

Figure 1:
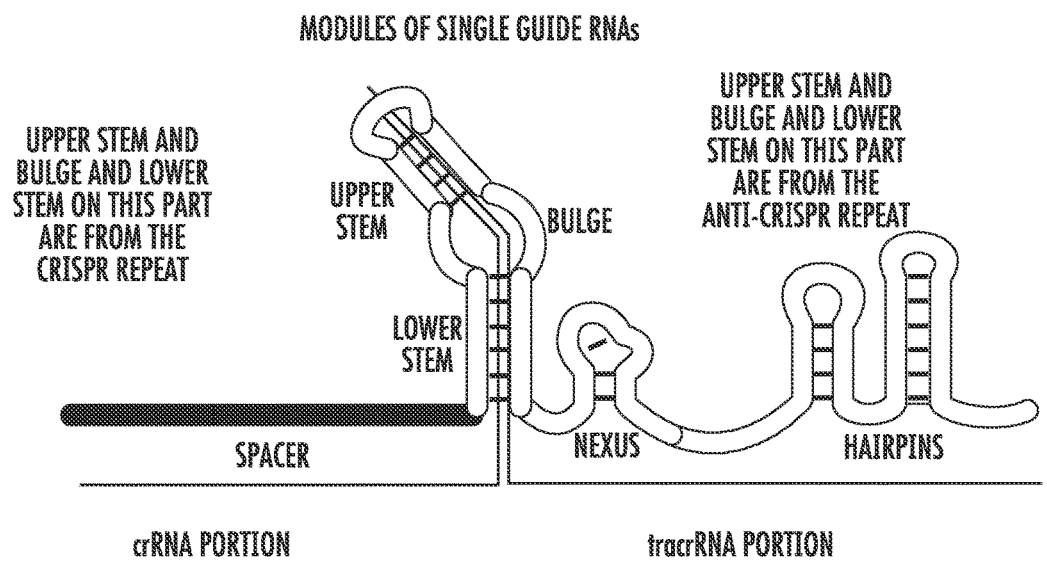
FIG. 1 shows the modules of a single guide RNA (crRNA-tracrRNA) as taught by the invention.

The present invention now will be described hereinafter with reference to the accompanying drawings and examples, in which embodiments of the invention are shown. This description is not intended to be a detailed catalog of all the different ways in which the invention may be implemented, or all the features that may be added to the instant invention. For example, features illustrated with respect to one embodiment may be incorporated into other embodiments, and features illustrated with respect to a particular embodiment may be deleted from that embodiment. Thus, the invention contemplates that in some embodiments of the invention, any feature or combination of features set forth herein can be excluded or omitted. In addition, numerous variations and additions to the various embodiments suggested herein will be apparent to those skilled in the art in light of the instant disclosure, which do not depart from the instant invention. Hence, the following descriptions are intended to illustrate some particular embodiments of the invention, and not to exhaustively specify all permutations, combinations and variations thereof.

Unless otherwise defined, all technical and scientific terms used herein have the same meaning as commonly understood by one of ordinary skill in the art to which this invention belongs. The terminology used in the description of the invention herein is for the purpose of describing particular embodiments only and is not intended to be limiting of the invention.

All publications, patent applications, patents and other references cited herein are incorporated by reference in their entireties for the teachings relevant to the sentence and/or paragraph in which the reference is presented.

Unless the context indicates otherwise, it is specifically intended that the various features and embodiments of the invention described herein can be used in any combination. Moreover, the present invention also contemplates that in some embodiments of the invention, any feature or combination of features set forth herein can be excluded or omitted. To illustrate, if the specification states that a composition comprises components A, B and C, it is specifically intended that any of A, B or C, or a combination thereof, can be omitted and disclaimed singularly or in any combination.

As used in the description of the invention and the appended claims, the singular forms "a," "an" and "the" are intended to include the plural forms as well, unless the context clearly indicates otherwise.

Also as used herein, "and/or" refers to and encompasses any and all possible combinations of one or more of the associated listed items, as well as the lack of combinations when interpreted in the alternative ("or").

The term "about," as used herein when referring to a measurable value such as a dosage or time period and the like, is meant to encompass variations of ±20%, ±10%, ±5%, ±1%, ±0.5%, or even ±0.1% of the specified amount.

As used herein, phrases such as "between X and Y" and "between about X and Y" should be interpreted to include X and Y. As used herein, phrases such as "between about X and Y" mean "between about X and about Y" and phrases such as "from about X to Y" mean "from about X to about Y."

The term "comprise," "comprises" and "comprising" as used herein, specify the presence of the stated features, integers, steps, operations, elements, and/or components, but do not preclude the presence or addition of one or more other features, integers, steps, operations, elements, components, and/or groups thereof.

As used herein, the transitional phrase "consisting essentially of" means that the scope of a claim is to be interpreted to encompass the specified materials or steps recited in the claim and those that do not materially affect the basic and novel characteristic(s) of the claimed invention. Thus, the term "consisting essentially of" when used in a claim of this invention is not intended to be interpreted to be equivalent to "comprising."

As used herein, the terms "increase," "increasing," "increased," "enhance," "enhanced," "enhancing," and "enhancement" (and grammatical variations thereof) describe an elevation of at least about 25%, 50%, 75%, 100%, 150%, 200%, 300%, 400%, 500% or more as compared to a control.

As used herein, the terms "reduce," "reduced," "reducing," "reduction," "diminish," "suppress," and "decrease" (and grammatical variations thereof), describe, for example, a decrease of at least about 5%, 10%, 15%, 20%, 25%, 35%, 50%, 75%, 80%, 85%, 90%, 95%, 97% or more, as compared to a control. In particular embodiments, the reduction results in no or essentially no (i.e., an insignificant amount, e.g., less than about 10% or even 5%) detectable activity or amount.

A "heterologous" or a "recombinant" nucleotide sequence is a nucleotide sequence not naturally associated with a host cell into which it is introduced, including non-naturally occurring multiple copies of a naturally occurring nucleotide sequence.

A "native" or "wild type" nucleic acid, nucleotide sequence, polypeptide or amino acid sequence refers to a naturally occurring or endogenous nucleic acid, nucleotide sequence, polypeptide or amino acid sequence. Thus, for example, a "wild type mRNA" is an mRNA that is naturally occurring in or endogenous to the organism. A "homologous" nucleic acid sequence is a nucleotide sequence naturally associated with a host cell into which it is introduced.

Also as used herein, the terms "nucleic acid," "nucleic acid molecule," "nucleotide sequence" and "polynucleotide" refer to RNA or DNA that is linear or branched, single or double stranded, or a hybrid thereof. The term also encompasses RNA/DNA hybrids. When dsRNA is produced synthetically, less common bases, such as inosine, 5-methylcytosine, 6-methyladenine, hypoxanthine and others can also be used for antisense, dsRNA, and ribozyme pairing. For example, polynucleotides that contain C-5 propyne analogues of uridine and cytidine have been shown to bind RNA with high affinity and to be potent antisense inhibitors of gene expression. Other modifications, such as modification to the phosphodiester backbone, or the 2'-hydroxy in the ribose sugar group of the RNA can also be made.

As used herein, the term "nucleotide sequence" refers to a heteropolymer of nucleotides or the sequence of these nucleotides from the 5' to 3' end of a nucleic acid molecule and includes DNA or RNA molecules, including cDNA, a DNA fragment or portion, genomic DNA, synthetic (e.g., chemically synthesized) DNA, plasmid DNA, mRNA, and anti-sense RNA, any of which can be single stranded or double stranded. The terms "nucleotide sequence" "nucleic acid," "nucleic acid molecule," "oligonucleotide" and "polynucleotide" are also used interchangeably herein to refer to a heteropolymer of nucleotides. Nucleic acid molecules and/or nucleotide sequences provided herein are presented herein in the 5' to 3' direction, from left to right and are represented using the standard code for representing the nucleotide characters as set forth in the U.S. sequence rules, 37 CFR §§ 1.821-1.825 and the World Intellectual Property Organization (WIPO) Standard ST.25. A "5' region" as used herein can mean the region of a polynucleotide that is nearest the 5' end. Thus, for example, an element in the 5' region of a polynucleotide can be located anywhere from the first nucleotide located at the 5' end of the polynucleotide to the nucleotide located halfway through the polynucleotide. A "3' region" as used herein can mean the region of a polynucleotide that is nearest the 3' end. Thus, for example, an element in the 3' region of a polynucleotide can be located anywhere from the first nucleotide located at the 3' end of the polynucleotide to the nucleotide located halfway through the polynucleotide.

As used herein, the term "gene" refers to a nucleic acid molecule capable of being used to produce mRNA, anti-sense RNA, miRNA, anti-microRNA antisense oligodeoxyribonucleotide (AMO) and the like. Genes may or may not be capable of being used to produce a functional protein or gene product. Genes can include both coding and non-coding regions (e.g., introns, regulatory elements, promoters, enhancers, termination sequences and/or 5' and 3' untranslated regions). A gene may be "isolated" by which is meant a nucleic acid that is substantially or essentially free from components normally found in association with the nucleic acid in its natural state. Such components include other cellular material, culture medium from recombinant production, and/or various chemicals used in chemically synthesizing the nucleic acid.

The terms, "invasive foreign genetic element," "invasive foreign nucleic acid" or "invasive foreign DNA" mean DNA that is foreign to the bacteria or archaea (e.g., genetic elements from, for example, pathogens including, but not limited to, viruses, bacteriophages, and/or plasmids).

The terms "complementary" or "complementarily," as used herein, refer to the natural binding of polynucleotides under permissive salt and temperature conditions by base-pairing. For example, the sequence "A-G-T" binds to the complementary sequence "T-C-A." Complementarity between two single-stranded molecules may be "partial," in which only some of the nucleotides bind, or it may be complete when total complementarity exists between the single stranded molecules. The degree of complementarity between nucleic acid strands has significant effects on the efficiency and strength of hybridization between nucleic acid strands.

"Complement" as used herein can mean 100% complementarity or identity with the comparator nucleotide sequence or it can mean less than 100% complementarity (e.g., about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, and the like, complementarity).

A "portion" or "fragment" of a nucleotide sequence of the invention will be understood to mean a nucleotide sequence of reduced length relative (e.g., reduced by 1, 2, 3, 4, 5, 6, 7, 8, 9, 10, 11, 12, 13, 14, 15, 16, 17, 18, 19, 20 or more nucleotides) to a reference nucleic acid or nucleotide sequence and comprising, consisting essentially of and/or consisting of a nucleotide sequence of contiguous nucleotides identical or almost identical (e.g., 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% identical) to the reference nucleic acid or nucleotide sequence. Such a nucleic acid fragment or portion according to the invention may be, where appropriate, included in a larger polynucleotide of which it is a constituent.

Different nucleic acids or proteins having homology are referred to herein as "homologues." The term homologue includes homologous sequences from the same and other species and orthologous sequences from the same and other species. "Homology" refers to the level of similarity between two or more nucleic acid and/or amino acid sequences in terms of percent of positional identity (i.e., sequence similarity or identity). Homology also refers to the concept of similar functional properties among different nucleic acids or proteins. Thus, the compositions and methods of the invention further comprise homologues to the nucleotide sequences and polypeptide sequences of this invention. "Orthologous," as used herein, refers to homologous nucleotide sequences and/or amino acid sequences in different species that arose from a common ancestral gene during speciation. A homologue of a nucleotide sequence of this invention has a substantial sequence identity (e.g., at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, and/or 100%) to said nucleotide sequence of the invention.

As used herein "sequence identity" refers to the extent to which two optimally aligned polynucleotide or peptide sequences are invariant throughout a window of alignment of components, e.g., nucleotides or amino acids. "Identity" can be readily calculated by known methods including, but not limited to, those described in: *Computational Molecular Biology* (Lesk, A. M., ed.) Oxford University Press, New York (1988); *Biocomputing: Informatics and Genome Projects* (Smith, D. W., ed.) Academic Press, New York (1993); *Computer Analysis of Sequence Data, Part I* (Griffin, A. M., and Griffin, H. G., eds.) Humana Press, New Jersey (1994); *Sequence Analysis in Molecular Biology* (von Heinje, G., ed.) Academic Press (1987); and *Sequence Analysis Primer* (Gribskov, M. and Devereux, J., eds.) Stockton Press, New York (1991).

As used herein, the term "percent sequence identity" or "percent identity" refers to the percentage of identical nucleotides in a linear polynucleotide sequence of a reference ("query") polynucleotide molecule (or its complementary strand) as compared to a test ("subject") polynucleotide molecule (or its complementary strand) when the two sequences are optimally aligned. In some embodiments, "percent identity" can refer to the percentage of identical amino acids in an amino acid sequence.

As used herein, the phrase "substantially identical," or "substantial identity" in the context of two nucleic acid molecules, nucleotide sequences or protein sequences, refers to two or more sequences or subsequences that have at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, and/or 100% nucleotide or amino acid residue identity, when compared and aligned for maximum correspondence, as measured using one of the following sequence comparison algorithms or by visual inspection. In some embodiments of the invention, the substantial identity exists over a region of consecutive residues of an amino sequence of the invention that is at least about 50 residues to about 1400 residues in length, about 100 residues to about 1300 residues, about 150 residues to about 1250 residues, about 200 residues to about 1200 residues, about 250 residues to about 1150 residues, about 300 residues to about 1100 residues, about 350 residues to about 1050 residues, about 400 residues to about 1000 residues, about 450 residues to about 950 residues, about 500 residues to about 900 residues, about 550 residues to about 850 residues, about 50 residues to about 100 residues in length, about 100 residues to about 200 residues, about 200 residues to about 400 residues, about 300 residues to about 500 residues, about 400 residues to about 600 residues, and the like, and any value or range therein, up to the full length of the sequence. In some embodiments of the invention, the substantial identity exists over a region of consecutive nucleotides of a nucleotide sequence of the invention that is about 16 nucleotides to about 30 nucleotides, about 18 nucleotides to about 25 nucleotides, about 30 nucleotides to about 40 nucleotides, about 50 nucleotides to about 60 nucleotides, about 70 nucleotides to about 80 nucleotides, about 90 nucleotides to about 100 nucleotides, about 150 nucleotides to about 200 nucleotides, to about 250 nucleotide to about 400 nucleotides, about 500 nucleotides to about 750 nucleotides, about 700 nucleotides to about 1000 nucleotides, about 1250 nucleotides to about 2500 nucleotides, about 2000 nucleotides to about 4000 nucleotides, or more nucleotides in length, and any range therein, up to the full length of the sequence. In representative embodiments, the nucleotide sequences can be substantially identical over at least about 22 nucleotides. In some particular embodiments, the amino acid sequences are substantially identical over at least about 150 residues. In some embodiments, nucleotide sequences of the invention can be about 70% to about 100% identical over at least about 16 nucleotides to about 25 nucleotides. In some embodiments, nucleotide sequences of the invention can be about 75% to about 100% identical over at least about 16 nucleotides to about 25 nucleotides. In further embodiments, nucleotide sequences of the invention can be about 80% to about 100% identical over at least about 16 nucleotides to about 25 nucleotides. In some embodiments, sequences of the invention can be about 70% identical over at least about 18 nucleotides. In other embodiments, the sequences can be about 85% identical over about 22 nucleotides. In still other embodiments, the sequences can be 100% homologous over about 16 nucleotides. In a further embodiment, the sequences are substantially identical over the entire length of the coding regions. Furthermore, in representative embodiments, substantially identical nucleotide or protein sequences perform substantially the same function (e.g., repeats, Cas9 nuclease activity).

For sequence comparison, typically one sequence acts as a reference sequence to which test sequences are compared. When using a sequence comparison algorithm, test and reference sequences are entered into a computer, subsequence coordinates are designated if necessary, and sequence algorithm program parameters are designated. The sequence comparison algorithm then calculates the percent sequence identity for the test sequence(s) relative to the reference sequence, based on the designated program parameters.

Optimal alignment of sequences for aligning a comparison window are well known to those skilled in the art and may be conducted by tools such as the local homology algorithm of Smith and Waterman, the homology alignment algorithm of Needleman and Wunsch, the search for similarity method of Pearson and Lipman, and optionally by computerized implementations of these algorithms such as GAP, BESTFIT, FASTA, and TFASTA available as part of the GCG® Wisconsin Package® (Accelrys Inc., San Diego, Calif.). An "identity fraction" for aligned segments of a test sequence and a reference sequence is the number of identical components which are shared by the two aligned sequences divided by the total number of components in the reference sequence segment, i.e., the entire reference sequence or a smaller defined part of the reference sequence. Percent sequence identity is represented as the identity fraction multiplied by 100. The comparison of one or more polynucleotide sequences may be to a full-length polynucleotide sequence or a portion thereof, or to a longer polynucleotide sequence. For purposes of this invention "percent identity" may also be determined using BLASTX version 2.0 for translated nucleotide sequences and BLASTN version 2.0 for polynucleotide sequences.

Software for performing BLAST analyses is publicly available through the National Center for Biotechnology Information. This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al., 1990). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when the cumulative alignment score falls off by the quantity X from its maximum achieved value, the cumulative score goes to zero or below due to the accumulation of one or more negative-scoring residue alignments, or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, a cutoff of 100, M=5, N=−4, and a comparison of both strands. For amino acid sequences, the BLASTP program uses as defaults a wordlength (W) of 3, an expectation (E) of 10, and the BLOSUM62 scoring matrix (see Henikoff & Henikoff, Proc. Natl. Acad. Sci. USA 89: 10915 (1989)).

In addition to calculating percent sequence identity, the BLAST algorithm also performs a statistical analysis of the similarity between two sequences (see, e.g., Karlin & Altschul, Proc. Nat'l. Acad. Sci. USA 90: 5873-5787 (1993)). One measure of similarity provided by the BLAST algorithm is the smallest sum probability (P(N)), which provides an indication of the probability by which a match between two nucleotide or amino acid sequences would occur by chance. For example, a test nucleic acid sequence is considered similar to a reference sequence if the smallest sum probability in a comparison of the test nucleotide sequence to the reference nucleotide sequence is less than about 0.1 to less than about 0.001. Thus, in some embodiments of the invention, the smallest sum probability in a comparison of the test nucleotide sequence to the reference nucleotide sequence is less than about 0.001.

Two nucleotide sequences can also be considered to be substantially complementary when the two sequences hybridize to each other under stringent conditions. In some representative embodiments, two nucleotide sequences considered to be substantially complementary hybridize to each other under highly stringent conditions.

"Stringent hybridization conditions" and "stringent hybridization wash conditions" in the context of nucleic acid hybridization experiments such as Southern and Northern hybridizations are sequence dependent, and are different under different environmental parameters. An extensive guide to the hybridization of nucleic acids is found in Tijssen *Laboratory Techniques in Biochemistry and Molecular Biology—Hybridization with Nucleic Acid Probes* part I chapter 2 "Overview of principles of hybridization and the strategy of nucleic acid probe assays" Elsevier, New York (1993). Generally, highly stringent hybridization and wash conditions are selected to be about 5° C. lower than the thermal melting point ($T_m$) for the specific sequence at a defined ionic strength and pH.

The $T_m$ is the temperature (under defined ionic strength and pH) at which 50% of the target sequence hybridizes to a perfectly matched probe. Very stringent conditions are selected to be equal to the $T_m$ for a particular probe. An example of stringent hybridization conditions for hybridization of complementary nucleotide sequences which have more than 100 complementary residues on a filter in a Southern or northern blot is 50% formamide with 1 mg of heparin at 42° C., with the hybridization being carried out overnight. An example of highly stringent wash conditions is 0.1 5M NaCl at 72° C. for about 15 minutes. An example of stringent wash conditions is a 0.2× SSC wash at 65° C. for 15 minutes (see, Sambrook, infra, for a description of SSC buffer). Often, a high stringency wash is preceded by a low stringency wash to remove background probe signal. An example of a medium stringency wash for a duplex of, e.g., more than 100 nucleotides, is 1× SSC at 45° C. for 15 minutes. An example of a low stringency wash for a duplex of, e.g., more than 100 nucleotides, is 4-6× SSC at 40° C. for 15 minutes. For short probes (e.g., about 10 to 50 nucleotides), stringent conditions typically involve salt concentrations of less than about 1.0 M Na ion, typically about 0.01 to 1.0 M Na ion concentration (or other salts) at pH 7.0 to 8.3, and the temperature is typically at least about 30° C. Stringent conditions can also be achieved with the addition of destabilizing agents such as formamide. In general, a signal to noise ratio of 2× (or higher) than that observed for an unrelated probe in the particular hybridization assay indicates detection of a specific hybridization. Nucleotide sequences that do not hybridize to each other under stringent conditions are still substantially identical if the proteins that they encode are substantially identical. This can occur, for example, when a copy of a nucleotide sequence is created using the maximum codon degeneracy permitted by the genetic code.

The following are examples of sets of hybridization/wash conditions that may be used to clone homologous nucleotide sequences that are substantially identical to reference nucleotide sequences of the invention. In one embodiment, a reference nucleotide sequence hybridizes to the "test" nucleotide sequence in 7% sodium dodecyl sulfate (SDS), 0.5 M NaPO$_4$, 1 mM EDTA at 50° C. with washing in 2× SSC, 0.1% SDS at 50° C. In another embodiment, the reference nucleotide sequence hybridizes to the "test" nucleotide sequence in 7% sodium dodecyl sulfate (SDS), 0.5 M NaPO$_4$, 1 mM EDTA at 50° C. with washing in 1× SSC, 0.1% SDS at 50° C. or in 7% sodium dodecyl sulfate (SDS), 0.5 M NaPO$_4$, 1 mM EDTA at 50° C. with washing in 0.5× SSC, 0.1% SDS at 50° C. In still further embodiments, the reference nucleotide sequence hybridizes to the "test" nucleotide sequence in 7% sodium dodecyl sulfate (SDS), 0.5 M NaPO$_4$, 1 mM EDTA at 50° C. with washing in 0.1× SSC, 0.1% SDS at 50° C., or in 7% sodium dodecyl sulfate (SDS), 0.5 M NaPO$_4$, 1 mM EDTA at 50° C. with washing in 0.1× SSC, 0.1% SDS at 65° C.

In particular embodiments, a further indication that two nucleotide sequences or two polypeptide sequences are substantially identical can be that the protein encoded by the first nucleic acid is immunologically cross reactive with the protein encoded by the second nucleic acid.

Any nucleotide sequence and/or recombinant nucleic acid molecule of this invention can be codon optimized for expression in any organism of interest. Codon optimization is well known in the art and involves modification of a nucleotide sequence for codon usage bias using species specific codon usage tables. The codon usage tables are generated based on a sequence analysis of the most highly expressed genes for the organism/species of interest. When the nucleotide sequences are to be expressed in the nucleus, the codon usage tables are generated based on a sequence analysis of highly expressed nuclear genes for the species of interest. The modifications of the nucleotide sequences are determined by comparing the species specific codon usage table with the codons present in the native polynucleotide sequences. As is understood in the art, codon optimization of a nucleotide sequence results in a nucleotide sequence having less than 100% identity (e.g., 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, and the like) to the native nucleotide sequence but which still encodes a polypeptide having the same function as that encoded by the original, native nucleotide sequence. Thus, in representative embodiments of the invention, the nucleotide sequence and/or recombinant nucleic acid molecule of this invention can be codon optimized for expression in the particular plant species of interest. In some embodiments, the codon optimized nucleotide sequences of SEQ ID NOs:194-293, and/or a functional fragment thereof, have about 70% to about 99% identity to the nucleotide sequences of SEQ ID NO:194-293 and/or a functional fragment thereof.

In some embodiments, the recombinant nucleic acids molecules, nucleotide sequences and polypeptides of the invention are "isolated." An "isolated" nucleic acid molecule, an "isolated" nucleotide sequence or an "isolated" polypeptide is a nucleic acid molecule, nucleotide sequence or polypeptide that, by the hand of man, exists apart from its native environment and is therefore not a product of nature. An isolated nucleic acid molecule, nucleotide sequence or polypeptide may exist in a purified form that is at least partially separated from at least some of the other components of the naturally occurring organism or virus, for example, the cell or viral structural components or other polypeptides or nucleic acids commonly found associated with the polynucleotide. In representative embodiments, the isolated nucleic acid molecule, the isolated nucleotide sequence and/or the isolated polypeptide is at least about 1%, 5%, 10%, 20%, 30%, 40%, 50%, 60%, 70%, 80%, 90%, 95%, or more pure.

In other embodiments, an isolated nucleic acid molecule, nucleotide sequence or polypeptide may exist in a non-native environment such as, for example, a recombinant host cell. Thus, for example, with respect to nucleotide sequences, the term "isolated" means that it is separated from the chromosome and/or cell in which it naturally occurs. A polynucleotide is also isolated if it is separated from the chromosome and/or cell in which it naturally occurs in and is then inserted into a genetic context, a chromosome and/or a cell in which it does not naturally occur (e.g., a different host cell, different regulatory sequences, and/or different position in the genome than as found in nature). Accordingly, the recombinant nucleic acid molecules, nucleotide sequences and their encoded polypeptides are "isolated" in that, by the hand of man, they exist apart from their native environment and therefore are not products of nature, however, in some embodiments, they can be introduced into and exist in a recombinant host cell.

In any of the embodiments described herein, the nucleotide sequences and/or recombinant nucleic acid molecules of the invention can be operatively associated with a variety of promoters and other regulatory elements for expression in an organism of interest and/or a cell of an organism of interest. Thus, in representative embodiments, a recombinant nucleic acid of this invention can further comprise one or more promoters operably linked to one or more nucleotide sequences.

By "operably linked" or "operably associated" as used herein, it is meant that the indicated elements are functionally related to each other, and are also generally physically related. Thus, the term "operably linked" or "operably associated" as used herein, refers to nucleotide sequences on a single nucleic acid molecule that are functionally associated. Thus, a first nucleotide sequence that is operably linked to a second nucleotide sequence, means a situation when the first nucleotide sequence is placed in a functional relationship with the second nucleotide sequence. For instance, a promoter is operably associated with a nucleotide sequence if the promoter effects the transcription or expression of said nucleotide sequence. Those skilled in the art will appreciate that the control sequences (e.g., promoter) need not be contiguous with the nucleotide sequence to which it is operably associated, as long as the control sequences function to direct the expression thereof. Thus, for example, intervening untranslated, yet transcribed, sequences can be present between a promoter and a nucleotide sequence, and the promoter can still be considered "operably linked" to the nucleotide sequence.

A "promoter" is a nucleotide sequence that controls or regulates the transcription of a nucleotide sequence (i.e., a coding sequence) that is operably associated with the promoter. The coding sequence may encode a polypeptide and/or a functional RNA. Typically, a "promoter" refers to a nucleotide sequence that contains a binding site for RNA polymerase II and directs the initiation of transcription. In general, promoters are found 5', or upstream, relative to the start of the coding region of the corresponding coding sequence. The promoter region may comprise other elements that act as regulators of gene expression. These include a TATA box consensus sequence, and often a CAAT box consensus sequence (Breathnach and Chambon, (1981) *Annu. Rev. Biochem.* 50:349). In plants, the CAAT box may be substituted by the AGGA box (Messing et al., (1983) in Genetic Engineering of Plants, T. Kosuge, C. Meredith and A. Hollaender (eds.), Plenum Press, pp. 211-227).

Promoters can include, for example, constitutive, inducible, temporally regulated, developmentally regulated, chemically regulated, tissue-preferred and/or tissue-specific promoters for use in the preparation of recombinant nucleic acid molecules, i.e., "chimeric genes" or "chimeric polynucleotides." These various types of promoters are known in the art.

The choice of promoter will vary depending on the temporal and spatial requirements for expression, and also depending on the host cell to be transformed. Promoters for many different organisms are well known in the art. Based on the extensive knowledge present in the art, the appropriate promoter can be selected for the particular host organism of interest. Thus, for example, much is known about promoters upstream of highly constitutively expressed genes in model organisms and such knowledge can be readily accessed and implemented in other systems as appropriate.

In some embodiments, a recombinant nucleic acid molecule of the invention can be an "expression cassette" or can be comprised within an expression cassette. As used herein, "expression cassette" means a recombinant nucleic acid molecule comprising a nucleotide sequence of interest (e.g., the nucleotide sequences of the invention), wherein said nucleotide sequence is operably associated with at least a control sequence (e.g., a promoter). Thus, some embodiments of the invention provide expression cassettes designed to express the nucleotides sequences of the invention.

An expression cassette comprising a nucleotide sequence of interest may be chimeric, meaning that at least one of its components is heterologous with respect to at least one of its other components. An expression cassette may also be one that is naturally occurring but has been obtained in a recombinant form useful for heterologous expression.

An expression cassette also can optionally include a transcriptional and/or translational termination region (i.e., termination region) that is functional in the selected host cell. A variety of transcriptional terminators are available for use in expression cassettes and are responsible for the termination of transcription beyond the heterologous nucleotide sequence of interest and correct mRNA polyadenylation. The termination region may be native to the transcriptional initiation region, may be native to the operably linked nucleotide sequence of interest, may be native to the host cell, or may be from another source (i.e., foreign or heterologous to the promoter, to the nucleotide sequence of interest, to the host, or any combination thereof).

An expression cassette of the invention also can include a nucleotide sequence for a selectable marker, which can be used to select a transformed host cell. As used herein, "selectable marker" means a nucleotide sequence that when expressed imparts a distinct phenotype to the host cell expressing the marker and thus allows such transformed cells to be distinguished from those that do not have the marker. Such a nucleotide sequence may encode either a selectable or screenable marker, depending on whether the marker confers a trait that can be selected for by chemical means, such as by using a selective agent (e.g., an antibiotic and the like), or on whether the marker is simply a trait that one can identify through observation or testing, such as by screening (e.g., fluorescence). Of course, many examples of suitable selectable markers are known in the art and can be used in the expression cassettes described herein.

In addition to expression cassettes, the nucleic acid molecules and nucleotide sequences described herein can be used in connection with vectors. The term "vector" refers to a composition for transferring, delivering or introducing a nucleic acid (or nucleic acids) into a cell. A vector comprises a nucleic acid molecule comprising the nucleotide sequence(s) to be transferred, delivered or introduced. Vectors for use in transformation of host organisms are well known in the art. Non-limiting examples of general classes of vectors include but are not limited to a viral vector, a plasmid vector, a phage vector, a phagemid vector, a cosmid vector, a fosmid vector, a bacteriophage, an artificial chromosome, or an Agrobacterium binary vector in double or single stranded linear or circular form which may or may not be self transmissible or mobilizable. A vector as defined herein can transform prokaryotic or eukaryotic host either by integration into the cellular genome or exist extrachromosomally (e.g. autonomous replicating plasmid with an origin of replication). Additionally included are shuttle vectors by which is meant a DNA vehicle capable, naturally or by design, of replication in two different host organisms, which may be selected from actinomycetes and related species, bacteria and eukaryotic (e.g. higher plant, mammalian, yeast or fungal cells). In some representative embodiments, the nucleic acid in the vector is under the control of, and operably linked to, an appropriate promoter or other regulatory elements for transcription in a host cell. The vector may be a bi-functional expression vector which functions in multiple hosts. In the case of genomic DNA, this may contain its own promoter or other regulatory elements and in the case of cDNA this may be under the control of an appropriate promoter or other regulatory elements for expression in the host cell. Accordingly, the nucleic acid molecules of this invention and/or expression cassettes can be comprised in vectors as described herein and as known in the art.

As used herein, "contact", "contacting", "contacted," and grammatical variations thereof, refers to placing the components of a desired reaction together under conditions suitable for carrying out the desired reaction (e.g., transcriptional control, genome editing, nicking, cleavage, and/or amplifying nucleic acids).

"Introducing," "introduce," "introduced" (and grammatical variations thereof) in the context of a polynucleotide of interest means presenting the nucleotide sequence of interest to the host organism or cell of said organism (e.g., host cell) in such a manner that the nucleotide sequence gains access to the interior of a cell. Where more than one nucleotide sequence is to be introduced these nucleotide sequences can be assembled as part of a single polynucleotide or nucleic acid construct, or as separate polynucleotide or nucleic acid constructs, and can be located on the same or different expression constructs or transformation vectors. Accordingly, these polynucleotides can be introduced into a host cell in a single transformation event, in separate transformation events, or, for example, they can be incorporated into an organism by conventional breeding protocols.

The term "transformation" as used herein refers to the introduction of a heterologous nucleic acid into a cell. Transformation of a cell may be stable or transient. Thus, in some embodiments, a host cell or host organism is stably transformed with a nucleic acid molecule of the invention.

In other embodiments, a host cell or host organism is transiently transformed with a recombinant nucleic acid molecule of the invention.

"Transient transformation" in the context of a polynucleotide means that a polynucleotide is introduced into the cell and does not integrate into the genome of the cell.

By "stably introducing" or "stably introduced" in the context of a polynucleotide introduced into a cell is intended that the introduced polynucleotide is stably incorporated into the genome of the cell, and thus the cell is stably transformed with the polynucleotide.

"Stable transformation" or "stably transformed" as used herein means that a nucleic acid molecule is introduced into a cell and integrates into the genome of the cell. As such, the integrated nucleic acid molecule is capable of being inherited by the progeny thereof, more particularly, by the progeny of multiple successive generations. "Genome" as used herein also includes the nuclear and the plastid genome, and therefore includes integration of the nucleic acid into, for example, the chloroplast or mitochondrial genome. Stable transformation as used herein can also refer to a transgene that is maintained extrachromasomally, for example, as a minichromosome or a plasmid.

Transient transformation may be detected by, for example, an enzyme-linked immunosorbent assay (ELISA) or Western blot, which can detect the presence of a peptide or polypeptide encoded by one or more transgene introduced into an organism. Stable transformation of a cell can be detected by, for example, a Southern blot hybridization assay of genomic DNA of the cell with nucleic acid sequences which specifically hybridize with a nucleotide sequence of a transgene introduced into an organism (e.g., a plant). Stable transformation of a cell can be detected by, for example, a Northern blot hybridization assay of RNA of the cell with nucleic acid sequences which specifically hybridize with a nucleotide sequence of a transgene introduced into a host organism. Stable transformation of a cell can also be detected by, e.g., a polymerase chain reaction (PCR) or other amplification reactions as are well known in the art, employing specific primer sequences that hybridize with target sequence(s) of a transgene, resulting in amplification of the transgene sequence, which can be detected according to standard methods Transformation can also be detected by direct sequencing and/or hybridization protocols well known in the art.

Accordingly, in some embodiments, the nucleotide sequences, constructs, expression cassettes can be expressed transiently and/or they can be stably incorporated into the genome of the host organism.

A recombinant nucleic acid molecule/polynucleotide of the invention can be introduced into a cell by any method known to those of skill in the art. In some embodiments of the invention, transformation of a cell comprises nuclear transformation. In other embodiments, transformation of a cell comprises plastid transformation (e.g., chloroplast transformation). In still further embodiments, the recombinant nucleic acid molecule/polynucleotide of the invention can be introduced into a cell via conventional breeding techniques.

Procedures for transforming both eukaryotic and prokaryotic organisms are well known and routine in the art and are described throughout the literature (See, for example, Jiang et al. 2013. *Nat. Biotechnol.* 31:233-239; Ran et al. *Nature Protocols* 8:2281-2308 (2013))

A nucleotide sequence therefore can be introduced into a host organism or its cell in any number of ways that are well known in the art. The methods of the invention do not depend on a particular method for introducing one or more nucleotide sequences into the organism, only that they gain access to the interior of at least one cell of the organism. Where more than one nucleotide sequence is to be introduced, they can be assembled as part of a single nucleic acid construct, or as separate nucleic acid constructs, and can be located on the same or different nucleic acid constructs. Accordingly, the nucleotide sequences can be introduced into the cell of interest in a single transformation event, or in separate transformation events, or, alternatively, where relevant, a nucleotide sequence can be incorporated into a plant, for example, as part of a breeding protocol.

The present invention is directed to the use of CRISPR-Cas systems for site-specific cleavage or nicking of a target DNA, transcriptional control of a target DNA, DNA editing, cleaving a double stranded polynucleotide, for detection and typing of bacteria, and for introducing immunity to invasive foreign DNA (e.g., bacteriophage, plasmid, and the like) into bacteria.

In one aspect of the invention a protein-RNA complex is provided, comprising, consisting essentially of, or consisting of the following components: (a) a Cas9 polypeptide comprising, consisting essentially of, or consisting of an amino acid sequence having at least about 80% (e.g., 80%, 81%, 82%, 83%, 84%, 85%, 86%, 87%, 88%, 89%, 90%, 91%, 92%, 93%, 94%, 95%, 96%, 97%, 98%, 99%, and/or 100%) identity to an amino acid sequence of any of SEQ ID NOs:194-293 and/or a functional fragment thereof; (b) a Clustered Regularly Interspaced Short Palindromic Repeats (CRISPR) RNA (crRNA) comprising a 3' region and a 5' region, wherein the 3' region comprises at least about 10 consecutive nucleotides (e.g., about 10, 11, 12, 13, 14, 15, 16, 17, 18, 19, 20, or more consecutive nucleotides) of a Clustered Regularly Interspaced Short Palindromic Repeats (CRISPR) repeat comprising a nucleotide sequence of any one of the nucleotide sequences of SEQ ID NOs:1-98, and/or a functional fragment thereof, and the 5' region comprises at least about 10 consecutive nucleotides (e.g., about 10, 11, 12, 13, 14, 15, 16, 17, 18, 19, 20, or more consecutive nucleotides) of a spacer sequence located upstream of the repeat; and (c) a tracrRNA comprising a 5' and 3' region wherein at least a portion of the 5' region of the tracrRNA is complementary to the 3' region (CRISPR repeat) of the crRNA.

In a further aspect, the present invention provides a chimeric RNA construct comprising, consisting essentially of, or consisting of (a) a crRNA comprising a 3' region and a 5' region, wherein the 3' region comprises at least about 10 consecutive nucleotides (e.g., about 10, 11, 12, 13, 14, 15, 16, 17, 18, 19, 20, or more consecutive nucleotides) of a CRISPR repeat comprising a nucleotide sequence of any one of the nucleotide sequences of SEQ ID NOs:1-98, and/or a functional fragment thereof, and the 5' region comprises at least about 10 consecutive nucleotides (e.g., about 10, 11, 12, 13, 14, 15, 16, 17, 18, 19, 20, or more consecutive nucleotides) of a spacer sequence located immediately upstream of the repeat, and (b) a tracrRNA comprising a 5' and 3' region, wherein at least a portion of the 5' region of the tracrRNA is complementary to the 3' region (repeat) of the crRNA and the 3' region of said tracrRNA forms secondary structures (e.g., hairpin structures).

In some embodiments, the 5' region of the tracrRNA of the protein-RNA complex and/or the chimeric RNA can comprise, consist essentially of, or consist of at least about 20 nucleotides (e.g., 20, 21, 22, 23, 24, 25, 26, 27, 28, 29, 30, 31, 32, 33, 34, 35, 36 or more consecutive nucleotides) complementary to the at least 20 consecutive nucleotides of the 3' region of the crRNA. In some embodiments, the tracrRNA of the protein-RNA complex and/or the chimeric RNA comprises a nucleotide sequence of any one of the nucleotide sequences of SEQ ID NOs:99-193, and/or a functional fragment thereof.

Figure 13:
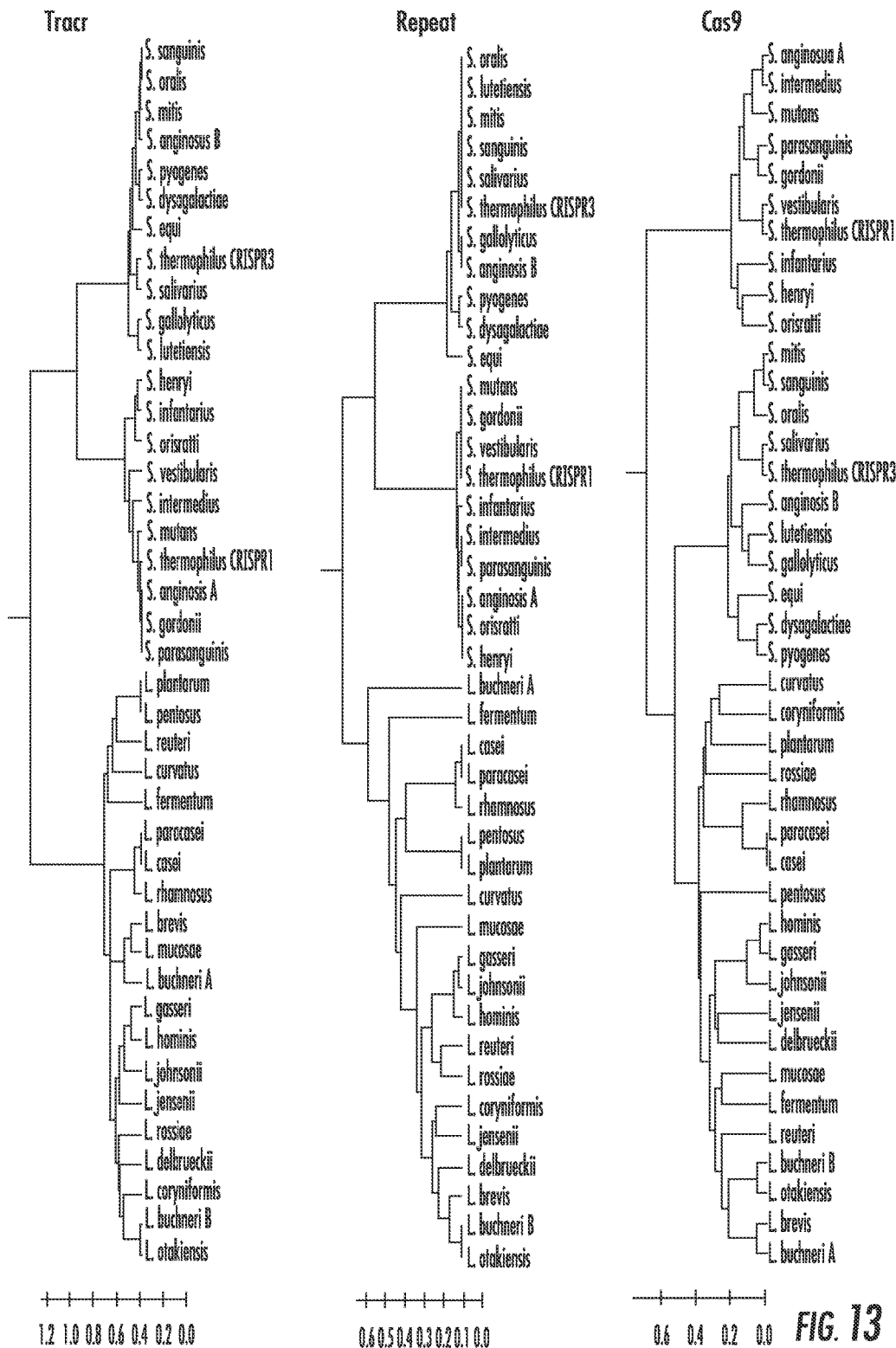
FIG. 13 shows congruence between tracrRNA (left), CRISPR repeat (middle) and Cas9 (right) sequence clustering. Consistent grouping is observed across the three sequence-based phylogenetic trees, into three families.

As is well known in the art, Cas9 polypeptides are multifunctional proteins that bind DNA (e.g., target DNA), RNA (guide RNA) and specific nucleotide sequences called protospacer adjacent motifs (PAM), in addition to comprising nuclease/nickase activity (RuH and NHN motifs) that allows them to cut each strand of a double stranded nucleic acid. In some embodiments of the invention, a CRISPR Cas9 polypeptide can be a Cas9 polypeptide from *Lactobacillus* spp., *Bifidobacterium* spp., *Kandleria* spp., *Leuconostoc* spp., *Oenococcus* spp., *Pediococcus* spp., *Streptococcus* spp., *Weissella* spp., and/or *Olsenella* spp. As noted above, Cas9 polypeptides can recognize and bind to the PAM sequences that are located on the target DNA. Cas9 polypeptides exhibit specificity for the particular PAM sequence that they recognize and bind to. For example, FIG. 13 shows the relatedness of Cas9 polypeptide sequences from various bacteria and archeae species/strains and the protospacer adjacent motifs (PAMs) that are recognized by the Cas9 polypeptides as described herein.

In representative embodiments, a Cas9 polypeptide can be encoded by a nucleotide sequence of any of SEQ ID NOs:294-388, and/or a functional fragment thereof, or a polypeptide comprising the amino acid sequence of SEQ ID NOs:194-293, and/or a functional fragment thereof, or encoded by a nucleotide sequence encoding a polypeptide comprising the amino acid sequence of SEQ ID NOs:194-293, and/or a functional fragment thereof. In some embodiments, a Cas9 polypeptide can comprise a HNH and/or a RuvC motif comprising HNH and/or RuvC nickase activities, respectively. In other embodiments, a Cas9 polypeptide can be a deactivated (e.g., mutated, dCAs9) Cas9 polypeptide, wherein the deactivated Cas9 does not comprise HNH and/or RuvC nickase activities. The HNH and RuvC motifs have been characterized in *S. thermophilus* (see, e.g., Sapranauskas et al. *Nucleic Acids Res.* 39:9275-9282 (2011)) and one of skill would be able to identify and mutate these motifs in Cas9 polypeptides from other organisms. Notably, a Cas9 polypeptide in which the HNH motif and/or RuvC motif is/are specifically mutated so that the nickase activity is reduced, deactivated, and/or absent, can retain one or more of the other known Cas9 functions including DNA, RNA and PAM recognition and binding activities and thus remain functional with regard to these activities, while non-functional with regard to one or both nickase activities.

The structure of Cas9 polypeptides is described in the art and understood to comprise a nuclease lobe (NUC) and a recognition lobe (REC), with the NUC lobe interacting with the PAM and target DNA, while the REC lobe interacts with and binds to the sgRNA (crRNA-tracrRNA) (see, Barrangou, R. *Science* 344:707-708 (2104), generally and figure presented therein. It is between the groove located between the two lobes that the sgRNA-target DNA heteroduplex is formed. Id. Further, as noted above, the HNH and RuvC motifs of a Cas9 polypeptide have been characterized (Sapranauskas et al. *Nucleic Acids Res.* 39:9275-9282 (2011)). Additional details regarding the structure of Cas9 polypeptides and their interaction with tracrRNA and crRNA (sgRNAs) can be found in Nishimasu et al. (*Cell* 156(5):935-949 (2014)). Here, they provide the crystal structure of Cas9 in complex with guide RNA and target RNA as well as schematics of the sgRNA:target DNA complex and the structure of the Cas9 polypeptide. Thus, the structure of the Cas9 polypeptide is well characterized with the various functions of the protein associated with defined structures within the polypeptide.

Accordingly, a further embodiment of the invention provides a functional fragment of a Cas9 polypeptide comprising one or more of the functions of the functions of a Cas9 polypeptide including but not limited to HNH activity, RuvC activity, DNA recognition and/or binding, RNA recognition and/or binding, and/or PAM recognition and/or binding.

Accordingly, in further embodiments, the CRISPR Cas9 polypeptide can be a functional fragment of a CRISPR Cas9 polypeptide. Accordingly, in some embodiments, a functional fragment of a CRISPR Cas9 polypeptide can be a functional fragment of a Cas9 polypeptide from *Lactobacillus* spp., *Bifidobacterium* spp., *Kandleria* spp., *Leuconostoc* spp., *Oenococcus* spp., *Pediococcus* spp., *Streptococcus* spp., *Weissella* spp., and/or *Olsenella* spp. In other embodiments, a functional fragment of a CRISPR Cas9 polypeptide can be a functional fragment from an amino acid sequence of any of SEQ ID NOs:194-293. In some embodiments, the functional fragment of a Cas9 polypeptide can comprise HNH and/or RuvC nickase activities, respectively. In other embodiments, the functional fragment of a Cas9 polypeptide can be deactivated (mutated) in that it does not comprise HNH and/or RuvC nickase activity. Notably, a Cas9 functional fragment comprising a mutation in either or both the HNH motif and RuvC motif so that one or both nickase activities are reduced, deactivated, and/or absent, can retain their DNA, RNA and/or PAM recognition and binding activities, as described above, and therefore, such Cas9 fragments remain functional fragments with regard to at least one of these recognition and binding activities.

In some embodiments, a crRNA of this invention, comprising a 3' region and a 5' region, can further comprise a CRISPR repeat located upstream of the spacer sequence, wherein the CRISPR repeat comprises, consists essentially, or consists of at least about 10 consecutive nucleotides of CRISPR repeat from *Lactobacillus* spp., *Bifidobacterium* spp., *Kandleria* spp., *Leuconostoc* spp., *Oenococcus* spp., *Pediococcus* spp., *Streptococcus* spp., *Weissella* spp., and/or *Olsenella* spp. (e.g., SEQ ID NOs:1-98, or a functional fragment thereof). Therefore, in representative embodiments, a crRNA can comprise, consist essentially of, or consist of (from 5' to 3') a spacer sequence—a CRISPR repeat, or a CRISPR repeat—a spacer sequence—a CRISPR repeat. As used herein, a "functional fragment" of a crRNA means a portion of said crRNA which binds to the corresponding tracrRNA and/or a portion of which is recognized and bound to a corresponding Cas9 polypeptide. FIG. 4 shows exemplary CRISPR repeat sequence alignments with conserved and consensus nucleotides specified at the bottom of each family, with Sth3 (top), Sth1 (middle) and Lb (bottom) families, thereby providing structural references for crRNA fragments for use with this invention.

A "spacer sequence" as used herein means a sequence that is upstream (5') of a repeat in a crRNA. Alternatively, when the crRNA comprises two repeats (i.e., a first and a second repeat) the spacer sequence is located between the two repeats (i.e., the spacer sequence is located 3' of the first repeat and 5' of the second repeat). Generally, the spacer sequence comprises a polynucleotide sequence that is complementary to a target DNA and/or an invasive foreign (e.g., heterologous) DNA (e.g., a nucleotide sequence from a bacteriophage, plasmid or chromosome that is foreign to, for example, a bacterium, a bacterium or an archaeon). The spacer sequence can be at least 70% complementary (e.g., 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% homologous) to the target or invasive foreign DNA. In representative embodiments, the spacer sequence is 100% complementary to the target or invasive foreign DNA. In other embodiments, the complementarity of the 3' region of the spacer sequence to the target or invasive foreign DNA is 100% but is less than 100% in the 5' region of the spacer. Thus, for example, the first 7, 8, 9, 10, 11, 12, 13, 14, 15, 16, and the like, nucleotides in the 3' region of a 20 nucleotide spacer sequence (seed sequence) can be 100% complementary the target or invasive foreign DNA, while the remaining nucleotides in the 5' region of the spacer sequence are at least about 70% complementary to the target or invasive foreign DNA. In representative embodiments, the first 12 nucleotides of the spacer sequence can be 100% complementary to the target or invasive foreign DNA, while the remaining nucleotides in the 5' region of the spacer sequence be at least about 70% complementary to the target or invasive foreign DNA.

In some embodiments, a repeat for use with this invention can comprise, consist essentially of, or consist of a repeat from *Lactobacillus* spp., *Bifidobacterium* spp., *Kandleria* spp., *Leuconostoc* spp., *Oenococcus* spp., *Pediococcus* spp., *Streptococcus* spp., *Weissella* spp., and/or *Olsenella* spp. In some embodiments, a repeat from *Lactobacillus* spp., *Bifidobacterium* spp., *Kandleria* spp., *Leuconostoc* spp., *Oenococcus* spp., *Pediococcus* spp., *Streptococcus* spp., *Weissella* spp., and/or *Olsenella* spp. comprises, consists essentially of, or consists of a nucleotide sequence of any of SEQ ID NOs:1-98, or a functional fragment thereof.

The 5' region of the tracrRNA is described herein as complementary to the 3' region (repeat) of the crRNA. In some embodiments, "complementary" means having at least about 70% or more (e.g., about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100%) homology to the 3' repeat of the crRNA. Thus, for example, the 5' region of a tracrRNA that is complementary to a 20 nucleotide sequence of a crRNA can have complementarity to about 14 out of 20 consecutive nucleotides of the crRNA repeat. In representative embodiments, the 5' region of a tracrRNA that is complementary to a 20 nucleotide sequence of a crRNA can have complementarity to at least 7 consecutive nucleotides (e.g., 7, 8, 9, 10, 11, 12, 13, 14, 15, 16, 17, 18, 19, 20 nucleotides) of the crRNA repeat. In some embodiments, a tracrRNA can comprise, consist essentially of, or consist of a nucleotide sequence of any of SEQ ID NOs:99-193, or a functional fragment thereof. Thus, in some embodiments, a tracrRNA useful with this invention can comprise, consist essentially of, or consist of a "functional" fragment of a nucleotide sequence of any of SEQ ID NOs:99-193, wherein said functional fragment retains the function of at least one of the motifs of a tracrRNA as described herein (e.g., a nexus motif, a hairpin motif, a lower stem motif, an upper stem motif, and/or a bulge motif; see, e.g., FIG. 1). Therefore a functional fragment of a nucleotide sequence of any of SEQ ID NOs:99-193 can comprise, consist essentially of, consist of a nexus motif, a hairpin motif, a lower stem motif, an upper stem motif, a bulge motif and/or any combination thereof. In particular embodiments, a functional fragment of a tracrRNA of the invention can comprise, consist essentially of, or consist of a nexus motif, and/or a hairpin motif (see e.g., FIG. 1). These motifs are involved in the binding (complementary (full and/or partial) hybridization) between the tracrRNA and the crRNA to form a sgRNA (e.g., upper stem, bulge, lower stem) as well as the interaction between the tracrRNA and the REC lobe of the Cas9 polypeptide (See, e.g., Barrangou, R. *Science* 344:707-708 (2104)).

The present invention further provides expression cassettes and/or vectors comprising or encoding the nucleotide sequences of this invention.

The present invention additionally provides a cell comprising nucleotide sequences, protein-RNA complexes, and/or the chimeric RNAs of this invention. A cell can be from any organism useful with this invention including, but not limited to, a plant cell, bacteria cell, fungal cell, mammalian cell, insect cell, or archaeon cell. In some embodiments, the cell can be, for example, from *Homo sapiens, Drosophila melanogaster, Mus musculus, Rattus norvegicus, Caenorhabditis elegans, Saccharomyces cerevisiae, Zea mays,* or *Arabidopsis thaliana,* and the like.

Figure 2:
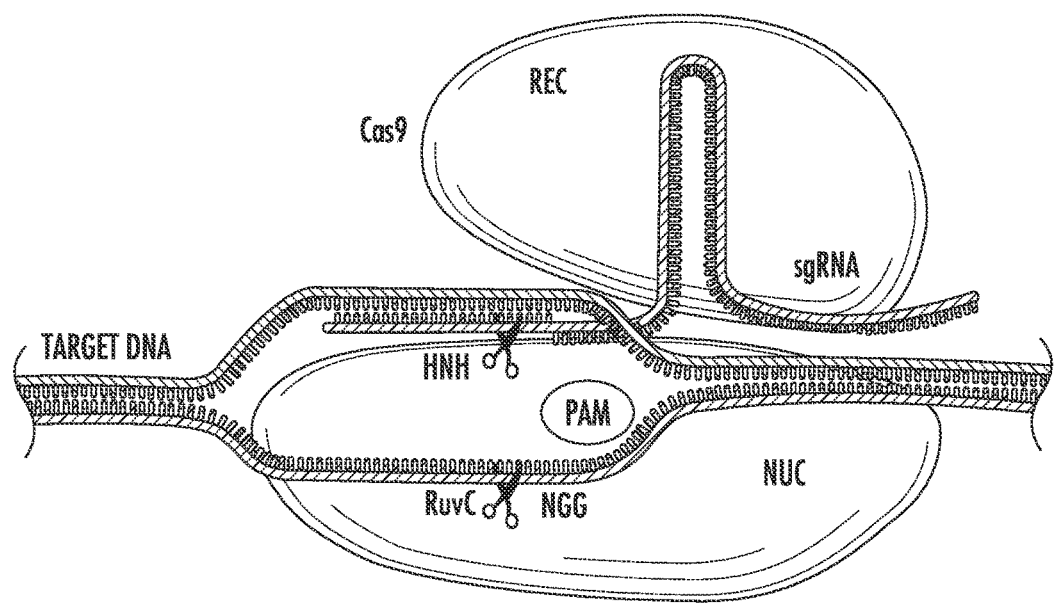
FIG. 2 shows Cas9 targeting the protospacer adjacent motif (PAM) sequence on the target DNA and the formation of the sgRNA-target DNA heteroduplex; the recognition (REC) lobe of Cas9 interacts with the sgRNA, while the nuclease (NUC) lobe drives the interaction with the PAM and target DNA.
Figure 3:
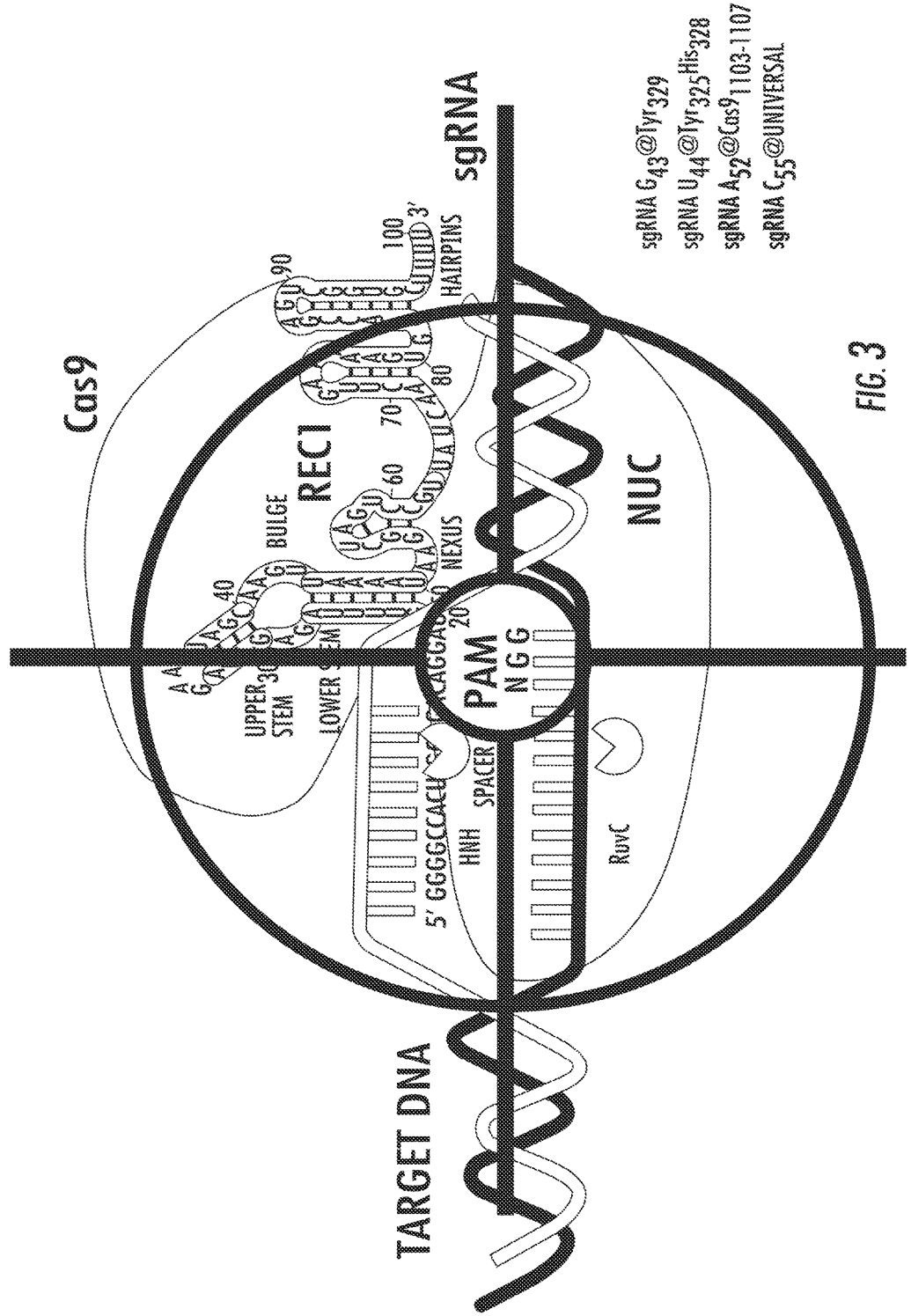
FIG. 3 provides a further representation of the target DNA, sgRNA, Cas9 interaction (SEQ ID NOs:440-443).

In a further embodiment of the invention, a method for site specific cleavage of a target DNA is provided, comprising contacting a protein-RNA complex of this invention with the target DNA, thereby producing a site specific cleavage of the target DNA in the region defined by the complementary binding of the spacer sequence of the crRNA to the target nucleic acid. In another embodiment of the invention, a method for site specific cleavage of a target DNA is provided, comprising contacting a chimeric RNA of this invention, or an expression cassette or vector comprising or encoding a chimeric RNA of this invention with the target DNA in the presence of a Cas9 polypeptide, thereby producing a site specific cleavage of the target nucleic acid in a region defined by complementary binding of the spacer sequence of the crRNA to the target DNA. (See, e.g., FIGS. 2-4)

Figure 5:
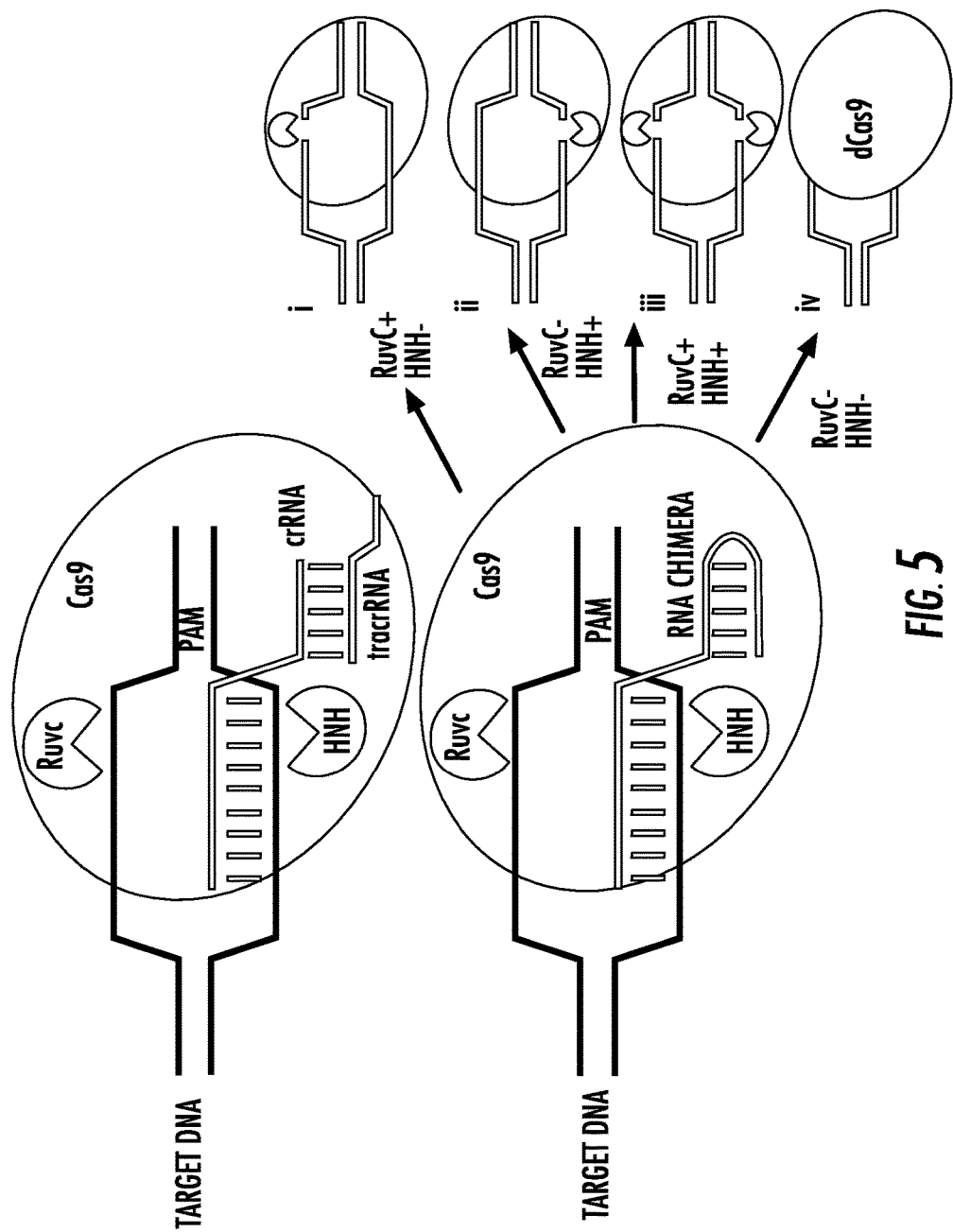
FIG. 5 shows crRNA guided cleavage of target DNA with engineered and native Cas9 nucleases; (i) site-specific cleavage of the (+) strand of a target DNA (Cas9 without NHN activity), (ii) site-specific cleavage of the (−) strand of a target DNA (Cas9 without RuvC activity), (iii) site specific cleavage of both strands of the target DNA (Cas9 with both HNH and RuvC activity), and (iv) transcriptional control of a target DNA (deactivated Cas9).

In some embodiments, a method of transcriptional control of a target DNA is provided, the method comprising: contacting a protein-RNA complex of this invention with the target DNA, wherein the Cas9 polypeptide of the complex is deactivated and the complex binds to the target DNA, thereby controlling the transcription of the target DNA. In other embodiments, a method of transcriptional control of a target DNA is provided, the method comprising: contacting a chimeric RNA of this invention, or an expression cassette or vector comprising or encoding a chimeric RNA of this invention with the target DNA in the presence of an deactivated Cas9 polypeptide, wherein the chimeric RNA binds to the target DNA, thereby controlling the transcription of the target DNA. (See, FIG. 5, FIG. 6B,C)

"Transcriptional control" as used herein means modulating expression of a target DNA (i.e., activation (increasing) and/or repression (decreasing) expression of the target DNA) (see, e.g., FIGS. 6B and 6C). Thus, in some embodiments, an deactivated Cas9 polypeptide can be fused with a transcriptional activator, thereby activating transcription of a target DNA and increasing expression of said target DNA. Any transcriptional activator now known or later identified can be used with this invention in a fusion construct with a Cas9 polypeptide as described herein. A non-limiting example of such a transcriptional activator is VP64. Repression of expression can be accomplished by, for example, using a nuclease free Cas9 with the protein-RNA complexes or chimeric RNAs of this invention, which bind to the target nucleic acid and interfere with or repress expression of the target nucleic acid.

In other embodiments, the invention provides a method of editing a target DNA, comprising: contacting the target DNA with a protein-RNA complex of this invention, wherein the complex binds to the target DNA, thereby editing the target DNA. In still other embodiments, the invention provides a method of editing DNA of a target DNA, comprising: contacting the target DNA with a chimeric RNA of this invention, or an expression cassette or vector encoding a chimeric RNA of this invention in the presence of a Cas9 polypeptide, wherein the chimeric RNA binds to the target DNA, thereby editing the target DNA. (See, FIG. 6A).

In some embodiments, contacting a target DNA with a protein-RNA complex comprises contacting the target DNA with a protein-RNA complex encoded or comprised in an expression cassette or vector. Accordingly, in some embodiments, an expression cassette and/or vector can be constructed to express a Cas9 polypeptide and produce a tracrRNA-crRNA (sgRNA). In other embodiments, a Cas9 polypeptide can be provided in combination with an expression cassette or vector comprising or encoding a sgRNA. In further embodiments, no expression cassette or vector is utilized, instead a protein-RNA complex itself can be contacted with the target DNA.

Additional embodiments of the invention provide a method for cleaving a double stranded polynucleotide, comprising contacting a protein-RNA complex, wherein the polynucleotide comprises, consists essentially of, or consists of (a) a protospacer sequence that is least about 80% (e.g., about 80%, 81%, 82%, 83%, 84%, 85%, 86%, 87%, 88%, 89%, 90%, 91%, 92%, 93%, 94%, 95%, 96%, 97%, 98%, 99%, or 100%) complementary to the spacer sequence in the crRNA in the complex, and (b) a protospacer adjacent motif (PAM) comprising, consisting essentially of, or consisting of a nucleotide sequence of 5'-NGG-3', 5'-NGAAA-3', 5'-NNG-3', 5'-NGA-3', 5'-NTAA-3', 5'-NTG-3', 5'-NNC-3', 5'-NNAAC-3', 5'-AGA-3', 5'-NNNANNA-3', 5'-NNANAA-3', 5'-NNAAAA-3', and/or 5'-AAAA-3' downstream from the protospacer sequence, thereby cleaving the polynucleotide in the region defined by complementary binding of the spacer sequence of the crRNA of the protein-RNA complex to the polynucleotide. In some embodiments, the polypeptide of the complex cleaves both strands of the ds polynucleotide at a cleavage site located 0 to 3 nucleotides upstream of the PAM sequence to create blunt ends (i.e., cleaves 3nt upstream of the 3' edge of the spacer sequence, which is 0 to 3 nucleotides away from the PAM sequence).

The present invention further provides a method for site specific cleavage of a target DNA, comprising contacting the target DNA with a CRISPR RNA (crRNA), said crRNA comprising a 5' region and a 3' region, and a trans-encoded CRISPR RNA (tracrRNA) comprising a 5' region and a 3' region in the presence of a Cas9 polypeptide, wherein (a) the crRNA comprises, consists essentially of, or consists of at its 3' region a repeat from *Lactobacillus* spp., *Bifidobacterium* spp., *Kandleria* spp., *Leuconostoc* spp., *Oenococcus* spp., *Pediococcus* spp., *Streptococcus* spp., *Weissella* spp., and/or *Olsenella* spp., (e.g., SEQ ID NOs:1-98, or a functional fragment thereof) and at its 5' region a spacer sequence from the target DNA, (b) the tracrRNA comprises, consists essentially of, or consists of a sequence at its 5' region that is complementary to the repeat of the crRNA, and (c) the spacer sequence hybridizes with a portion of the target DNA that is complementary to the spacer sequence and adjacent to a protospacer adjacent motif (PAM) comprising, consisting essentially of, or consisting of the nucleotide sequence of any one of the nucleotide sequences of 5'-NGG-3', 5'-NGAAA-3', 5'-NNG-3', 5'-NGA-3', 5'-NTAA-3', 5'-NTG-3', 5'-NNC-3', 5'-NNAAC-3', 5'-AGA-3', 5'-NNNANNA-3', 5'-NNANAA-3', 5'-NNAAAA-3', and/or 5'-AAAA-3', thereby resulting in a site specific cleavage of the target DNA in the region defined by the complementary binding of the spacer sequence of the crRNA to the target DNA. In some embodiments, the 3' region of the crRNA comprises, consists essentially of, or consists of at least about 10 consecutive nucleotides of the repeat and the 5' region of the crRNA comprises, consists essentially of, or consists of at least about 10 consecutive nucleotides of the spacer sequence. In further embodiments, the crRNA can comprise, consist essentially of, or consist of a nucleotide sequence of any one of the nucleotide sequences of SEQ ID NOs:1-98, and/or a functional fragment thereof, and/or the the tracrRNA can comprise, consist essentially of, or consist of a nucleotide sequence of any one of the nucleotide sequences of SEQ ID NOs:99-193, and/or a functional fragment thereof.

A Cas9 polypeptide or nuclease useful with this invention can be any Cas9 polypeptide from, for example, *Lactobacillus* spp., *Bifidobacterium* spp., *Kandleria* spp., *Leuconostoc* spp., *Oenococcus* spp., *Pediococcus* spp., *Streptococcus* spp., *Weissella* spp., and/or *Olsenella* spp. In some embodiments, a Cas9 polypeptide can comprise, consist essentially of, or consist of an amino acid sequence having at least about 80% (e.g., 80%, 81%, 82%, 83%, 84%, 85%, 86%, 87%, 88%, 89%, 90%, 91%, 92%, 93%, 94%, 95%, 96%, 97%, 98%, 99%, or 100%) identity to a polypeptide comprising the amino acid sequence of SEQ ID NOs:194-293, and/or a functional fragment thereof. Depending on the method for which it is being used, a Cas9 polypeptide can comprise the activity of an NHN and/or a RuvC nickase. In other embodiments, the Cas9 polypeptide is deactivated and therefore does not comprise HNH nickase activity. In some embodiments, the Cas9 polypeptide is deactivated and therefore does not comprise RuvC nickase activity. In still other embodiments, the Cas9 polypeptide is deactivated and therefore does not comprise RuvC nickase activity or HNH nickase activity. As described herein, Cas9 polypeptides are multifunctional proteins. Therefore, a Cas9 polypeptide that is deactivated with regard to either or both of the above described nickase activities, can still retain the polypeptide's other functions including DNA, RNA and PAM recognition and binding activity.

In other aspects of the invention, a method for site-specific nicking of a (+) strand of a double stranded target DNA is provided, the method comprising contacting a protein-RNA complex with a double stranded target DNA, wherein the complex comprises, consists essentially of, or consists of (a) a crRNA comprising, consisting essentially of, or consisting of a 3' region and a 5' region, wherein the 3' region comprises, consists essentially of, or consists of at least about 10 consecutive nucleotides of a CRISPR repeat from a *Lactobacillus* spp., *Bifidobacterium* spp., *Kandleria* spp., *Leuconostoc* spp., *Oenococcus* spp., *Pediococcus* spp., *Streptococcus* spp., *Weissella* spp., and/or *Olsenella* spp., and the 5' region comprises, consists essentially of, or consists of at least about 10 consecutive nucleotides of a spacer sequence located upstream of the repeat, (b) a tracrRNA comprising a 5' and 3' region wherein at least a portion of the 5' region of the tracrRNA is complementary to the 3' region (repeat) of the crRNA, and (c) a polypeptide comprising, consisting essentially of, or consisting of any of the amino acid sequences of SEQ ID NOs:194-293, and/or a functional fragment thereof, comprising a point mutation in the RuvC active site motif; and the target DNA comprises, consists essentially of, or consists of a protospacer sequence that is at least about 80% (e.g., 80%, 81%, 82%, 83%, 84%, 85%, 86%, 87%, 88%, 89%, 90%, 91%, 92%, 93%, 94%, 95%, 96%, 97%, 98%, 99%, or 100%) complementary to the spacer sequence in the crRNA and a protospacer adjacent motif (PAM) sequence of any one of the nucleotide sequences of 5'-NGG-3', 5'-NGAAA-3', 5'-NNG-3', 5'-NGA-3', 5'-NTAA-3', 5'-NTG-3', 5'-NNC-3', 5'-NNAAC-3', 5'-AGA-3', 5'-NNNANNA-3', 5'-NNANAA-3', 5'-NNAAAA-3', and/or 5'-AAAA-3' downstream from the proto-spacer sequence, wherein the polypeptide cleaves the (+) strand of the double stranded DNA at a cleavage site located 5 nucleotides upstream of the PAM sequence, thereby producing a site-specific nick in said double stranded target DNA. Thus, by mutating the RuvC active site, the Cas9 polypeptide can no longer cut the (−) strand of the target DNA (the RuvC motif cuts the (−) strand 5 nucleotides upstream of the PAM), thereby resulting only in a cut in the (+) strand of the target DNA.

In a further aspect of the invention, a method for site-specific nicking of the (−) strand of a double stranded target DNA is provided, the method comprising contacting a protein-RNA complex with a double stranded target DNA, wherein the complex comprises, consists essentially of, or consists of (a) a crRNA comprising, consisting essentially of, or consisting of a 3' region and a 5' region, wherein the 3' region comprises, consists essentially of, or consists of at least about 10 consecutive nucleotides of a CRISPR repeat from a *Lactobacillus* spp., *Bifidobacterium* spp., *Kandleria* spp., *Leuconostoc* spp., *Oenococcus* spp., *Pediococcus* spp., *Streptococcus* spp., *Weissella* spp., and/or *Olsenella* spp. and the 5' region comprises, consists essentially of, or consists of at least about 10 consecutive nucleotides of a spacer sequence located a upstream of the repeat, and (b) a tracrRNA comprising, consisting essentially of, or consisting of a 5' and 3' region wherein at least a portion of the 5' region of the tracrRNA is complementary to the 3' region (repeat) of the crRNA, (c) a polypeptide comprising, consisting essentially of, or consisting of any of the amino acid sequences of SEQ ID NOs:194-293, and/or a functional fragment thereof, comprising a point mutation in an HNH active site motif; and the target DNA comprises, consists essentially of, or consists of a protospacer sequence that is at least about 80% complementary to the spacer sequence in the crRNA and a protospacer adjacent motif (PAM) sequence comprising a nucleotide sequence of any one of the nucleotide sequences of 5'-NGG-3', 5'-NGAAA-3', 5'-NNG-3', 5'-NGA-3', 5'-NTAA-3', 5'-NTG-3', 5'-NNC-3', 5'-NNAAC-3', 5'-AGA-3', 5'-NNNANNA-3', 5'-NNANAA-3', 5'-NNAAAA-3', and/or 5'-AAAA-3' downstream from the proto-spacer sequence, wherein the polypeptide cleaves the (−) strand of the double stranded DNA at a cleavage site located 5 nucleotides upstream of the PAM sequence resulting in site-specific nicking of the target DNA. By providing a Cas9 comprising a mutation in an HNH active site, the Cas9 polypeptide can no longer cut the (+) strand of the target DNA (the HNH motif cuts the (+) strand 5nt upstream of the PAM), thereby resulting only in a cut in the (+) strand of the target DNA.

A CRISPR repeat from a *Lactobacillus* spp., *Bifidobacterium* spp., *Kandleria* spp., *Leuconostoc* spp., *Oenococcus* spp., *Pediococcus* spp., *Streptococcus* spp., *Weissella* spp., and/or *Olsenella* spp. useful for site specific nicking can include any one of the nucleotide sequences of SEQ ID NOs:1-98 or a functional fragment thereof. A tracrRNA useful for site specific nicking can include any one of the nucleotide sequences of SEQ ID NOs:99-193, or a functional fragment thereof. Thus, for example, in some embodiments, a tracrRNA can comprise, consist essentially of, or consist of a fragment of a nucleotide sequence of any of SEQ ID NOs:99-193, wherein said fragment comprises, consists essentially of, consists of a nexus motif, a hairpin motif, a lower stem motif, an upper stem motif, a bulge motif and/or a combination thereof (see e.g., FIG. 1). In particular embodiments, a fragment of a tracrRNA can comprise, consist essentially of, or consist of a fragment of a nucleotide sequence of any of SEQ ID NOs:99-193, wherein said fragment comprises, consists essentially of, consists of the nexus motif and the hairpin motif.

A further embodiment of the invention provides a method for site-specific cleavage of a target DNA in vivo, the method comprising: introducing a protein-RNA complex into at least one cell, wherein the protein-RNA complex comprises, consists essentially of, or consists of a crRNA comprising in its 3' region a repeat from *Lactobacillus* spp., *Bifidobacterium* spp., *Kandleria* spp., *Leuconostoc* spp., *Oenococcus* spp., *Pediococcus* spp., *Streptococcus* spp., *Weissella* spp., and/or *Olsenella* spp., and in its 5' region a spacer sequence having complementarity to a site in the target DNA in which a modification is desired; and a polypeptide having at least about 80% identity with a Cas9 polypeptide of *Lactobacillus* spp., *Bifidobacterium* spp., *Kandleria* spp., *Leuconostoc* spp., *Oenococcus* spp., *Pediococcus* spp., *Streptococcus* spp., *Weissella* spp., and/or *Olsenella* spp., and a tracrRNA comprising, consisting essentially of, or consisting of a sequence at its 5' region that is complementary to the repeat of the crRNA, thereby producing a site-specific cleavage of the target DNA molecule in a region that is determined by the complementary spacer sequence of the crRNA to the target DNA molecule. In some embodiments, the target DNA contains a proto-spacer sequence that is least 80% complementary to the spacer sequence in the crRNA of the protein-RNA complex, and a protospacer adjacent motif (PAM) sequence comprising, consisting essentially of, or consisting of a nucleotide sequence of any of the nucleotide sequences of 5'-NGG-3', 5'-NGAAA-3', 5'-NNG-3', 5'-NGA-3', 5'-NTAA-3', 5'-NTG-3', 5'-NNC-3', 5'-NNAAC-3', 5'-AGA-3', 5'-NNNANNA-3', 5'-NNANAA-3', 5'-NNAAAA-3', and/or 5'-AAAA-3' downstream from the proto-spacer sequence, wherein the polypeptide cleaves both target DNA strands at the cleavage site located 5 nucleotides upstream of the PAM sequence to create blunt ends.

Once the DNA is cleaved, it can then be modified by repair mechanisms as known in the art, notably non-homologous end-joining (NHEJ) and homology-directed repair (HDR). Thus, in some embodiments, a donor DNA can be provided for assisting in repair, such as a dsDNA template for homologous recombination in HDR-mediated repair. See, e.g., FIG. 6A, which provides a non-limiting cartoon depiction of genome editing using a Cas9 polypeptide and guide RNAs as described herein.

In representative embodiments, the polypeptide having at least about 80% identity with a Cas9 polypeptide can comprise, consist essentially of, or consist of an amino acid sequence of any of the amino acid sequences of SEQ ID NOs:194-293, and/or a functional fragment thereof, or a functional fragment thereof, the crRNA can comprise, consist essentially of, or consist of a nucleotide sequence of any one of the nucleotide sequences of SEQ ID NOs:1-98, and/or a functional fragment thereof, and/or the tracrRNA can comprise, consist essentially of, or consist of a nucleotide sequence of any one of the nucleotide sequences of SEQ ID NOs:99-193, and/or a functional fragment thereof.

In some embodiments, the polypeptide having at least about 80% identity with a Cas9 polypeptide can be codon optimized for the organism comprising the target DNA as described herein and as known in the art. Non-limiting examples of the types of organisms useful with this invention include plants, bacteria, fungi, mammals, insects, or archaea. Accordingly, in some embodiments, the polypeptide, and/or a functional fragment thereof, having at least about 80% identity with a Cas9 polypeptide (e.g., SEQ ID NOs:194-293, and/or a functional fragment thereof) can be codon optimized to be expressed in the organism comprising the target DNA.

In some embodiments, a repeat, a tracrRNA sequence, a Cas9 polypeptide or and/or a Cas9 nucleotide sequence can be from *Lactobacillus* spp., *Bifidobacterium* spp., *Kandleria* spp., *Leuconostoc* spp., *Oenococcus* spp., *Pediococcus* spp., *Streptococcus* spp., *Weissella* spp., and/or *Olsenella* spp. In representative embodiments, a repeat, a tracrRNA sequence, a Cas9 polypeptide or and/or a Cas9 nucleotide sequence can be from *Bifidobacterium bombi, Bifidobacterium dentium* LMG 11045, *Bifidobacterium merycicum* LMG 11341, *Kandleria vitulina* DSM 20405, *Lactobacillus agilis* DSM 20509, *Lactobacillus animalis* DSM 20602, *Lactobacillus apodemi* DSM 16634, *Lactobacillus brevis* subsp *gravensis* ATCC 27305, *Lactobacillus buchneri* CD034, *Lactobacillus buchneri* DSM 20057, *Lactobacillus cacaonum* DSM 21116, *Lactobacillus casei* str Zhang, *Lactobacillus ceti* DSM 22408, *Lactobacillus coryniformis* subsp *coryniformis* KCTC 3167, *Lactobacillus coryniformis torquens, Lactobacillus crispatus* FB049-03, *Lactobacillus curvatus* CRL 705, *Lactobacillus delbrueckii* subsp *lactis* CRL 581, *Lactobacillus delbrueckii jakobsenii* DSM 26046, *Lactobacillus diolivorans* DSM 14421, *Lactobacillus farciminis* DSM 20184, *Lactobacillus fermentum* DSM 20055, *Lactobacillus floricola* DSM 23037A, *Lactobacillus floricola* DSM 23037B, *Lactobacillus fuchuensis* DSM 14340, *Lactobacillus futsaii* JCM 17355, *Lactobacillus gasseri* K7, *Lactobacillus graminis* DSM 20719, *Lactobacillus hammesii* DSM 16381, *Lactobacillus hominis* CRBIP, *Lactobacillus hordei* DSM 19519A, *Lactobacillus hordei* DSM 19519B, *Lactobacillus jensenii* DSM 20557, *Lactobacillus johnsonii* DPC 6026, *Lactobacillus lindneri* DSM 20690, *Lactobacillus mali* ATCC 27304, *Lactobacillus mindensis* DSM 14500, *Lactobacillus mucosae* DSM 13345, *Lactobacillus namurensis* DSM 19117, *Lactobacillus nantensis* DSM 16982, *Lactobacillus nodensis* DSM 19682A, *Lactobacillus nodensis* DSM 19682B, *Lactobacillus oligofermentans* DSM 15707, *Lactobacillus otakiensis* DSM 19908, *Lactobacillus ozensis* DSM 23829, *Lactobacillus paracasei* subsp *paracasei* 8700:2, *Lactobacillus paracasei* subsp *tolerans* Lpl7, *Lactobacillus paracollinoides* DSM 15502, *Lactobacillus parakfiri* DSM 10551, *Lactobacillus pentosus* KCA1, *Lactobacillus pentosus* IG1, *Lactobacillus plantarum* EGD-AQ4, *Lactobacillus psittaci* DSM 15354, *Lactobacillus rennini* DSM 20253, *Lactobacillus reuteri* mlc3, *Lactobacillus rhamnosus* GG, *Lactobacillus rossiae* DSM 15814, *Lactobacillus ruminis* ATCC 25644, *Lactobacillus sakei carnosus* DSM 15831, *Lactobacillus salivarius* UCC 118, *Lactobacillus sanfranciscensis* DSM 20451, *Lactobacillus saniviri* DSM 24301, *Lactobacillus senmaizukei* DSM 21775, *Lactobacillus tucceti* DSM 20183, *Lactobacillus versmoldensis* DSM 14857, *Lactobacillus zymae* DSM 19395, *Leuconostoc gelidum* JB7, *Leuconostoc pseudomesenteroides* 4882, *Oenococcus kitaharae* DSM 17330, *Pediococcus inopinatus* DSM 20285, *Pediococcus lolii* DSM 19927, *Pediococcus parvulus* DSM 20332A, *Pediococcus parvulus* DSM 20332B, *Pediococcus stilesii* DSM 18001, *Streptococcus agalactiae* GB00300, *Streptococcus gallolyticus* ATCC BAA-2069, *Streptococcus henryi* DSM 19005, *Streptococcus mutans* NLML5, *Streptococcus oralis* SK304, *Streptococcus anginosus* 1_2_62CV, *Streptococcus anginosus* DSM 20563, *Streptococcus dysagalactiae* subsp *equisimilis*, *Streptococcus equi* subsp *zooepidemicus, Streptococcus gordonii* Challis substr CH1, *Streptococcus infantarius* subsp *infantarius, Streptococcus intermedius* B196, *Streptococcus lutetiensis* 033, *Streptococcus mitis* SK321, *Streptococcus mutans* UA 159, *Streptococcus orisratti* DSM 15617, *Streptococcus parasanguinis* F0449, *Streptococcus salivarius* K12, *Streptococcus sanguinis* SK330, *Streptococcus vestibularis* ATCC 49124, *Lactobacillus composti* DSM 18527, *Lactobacillus concavus* DSM 17758, *Lactobacillus secaliphilus* DSM 17896, *Weissella halotolerans* DSM 20190, *Weissella kandleri* DSM 20593, and/or *Olsenella uli* or any combination thereof.

In some embodiments, combinations of repeats, tracrRNA sequences, Cas9 polypeptide sequences and Cas9 nucleotide sequences that may be useful with this invention are set forth in Table 1.

TABLE 1

Combinations of repeats, tracrRNA sequences, and Cas9 polypeptides and nucleic acid sequences useful with the invention.

| Repeat (SEQ ID NO) | TracrRNA sequence (SEQ ID NO) | Cas9 polypeptide sequence (SEQ ID NO) | Cas9 nucleotide sequence (SEQ ID NO) | PAM Sequence |
|---|---|---|---|---|
| 1 |  | 194 | 294 | nnC |
| 2 | 99 | 195 | 295 |  |
| 3 | 100 | 196 | 296 | nGG |
| 4 | 101 | 197 | 297 |  |
| 5 | 102 | 198 | 298 | nGG |
| 6 | 103 | 199 | 299 |  |
| 7 | 104 | 200 | 300 |  |
| 8 | 105 | 201 | 301 | nnAAAA |
| 9 | 106 | 202 | 303 |  |
| 10 | 107 | 203 | 302 | nnnAnnA |
| 11 | 108 | 204 | 304 |  |
| 12 | 109 | 205 | 305 | nGA |
| 13 | 110 | 206 | 306 |  |
| 14 | 111 | 207 |  |  |
| 15 |  | 208 | 307 |  |
| 16 | 112 | 209 |  |  |
| 17 | 113 | 210 | 308 |  |
| 18 | 114 | 211 | 309 |  |
| 19 | 115 | 212 | 310 |  |
| 20 | 116 | 213 | 311 |  |
| 21 | 117 | 214 | 312 |  |
| 22 | 118 | 215 | 313 |  |
| 23 | 119 | 216 | 314 |  |
| 24 | 120 | 217 | 315 |  |
| 25 | 121 | 218 | 316 |  |
| 26 | 122 | 219 | 317 |  |
| 27 | 123 | 220 | 318 | nTAA |
| 28 | 124 | 221 | 319 |  |
| 29 | 125 | 222 | 320 |  |
| 30 | 126 | 223 | 321 |  |
| 31 | 127 | 224 | 322 |  |
| 32 | 128 | 225 | 323 |  |
| 33 | 129 | 226 | 324 | nGG |
| 34 | 130 | 227 | 325 |  |
| 35 | 131 | 228 | 326 |  |
| 36 | 132 | 229 | 327 | nnAnAA |
| 37 | 133 | 230 | 328 |  |
| 38 | 134 | 231 | 329 |  |
| 39 | 135 | 232 | 330 |  |
| 40 | 136 | 233 | 331 |  |
| 41 | 137 | 234 | 332 |  |
| 42 | 138 | 235 | 333 |  |
| 43 | 139 | 236 | 334 |  |
| 44 | 140 | 237 | 335 |  |
| 45 | 141 | 238 | 336 |  |
| 46 | 142 | 239 | 337 |  |
| 47 | 143 | 240 | 338 |  |
| 48 | 144 | 241 | 339 |  |
| 49 | 145 | 241 | 340 |  |
| 50 | 146 | 243 | 342 |  |

TABLE 1-continued

Combinations of repeats, tracrRNA sequences, and Cas9 polypeptides and nucleic acid sequences useful with the invention.

| Repeat (SEQ ID NO) | TracrRNA sequence (SEQ ID NO) | Cas9 polypeptide sequence (SEQ ID NO) | Cas9 nucleotide sequence (SEQ ID NO) | PAM Sequence |
|---|---|---|---|---|
| 51 | 147 | 244 | 341 | nnG |
| 52 | 148 | 245 | 343 | |
| 53 | 149 | 246 | 344 | |
| 54 | 150 | 247 | 345 | |
| 55 | 151 | 248 | | nGAAA |
| 56 | 152/153 | 249/250 | 346 | |
| 57 | 154 | 251 | 347 | |
| 58 | 155 | 252 | 348 | |
| 59 | 156 | 253 | 349 | |
| 60 | 157 | 254 | 350 | |
| 61 | 158 | 255 | 351 | |
| 62 | 159 | 256 | 352 | |
| 63 | 160 | 257 | 353 | |
| 64 | 161 | 258 | 354 | |
| 65 | 162 | 259 | 355 | |
| 66 | 163 | 260 | 356 | |
| 67 | 164 | 261 | 357 | |
| 68 | 165 | 262 | 358 | |
| 69 | 166 | 263 | 359 | nTG |
| 70 | 167 | 264 | 360 | |
| 71 | 168 | 265 | 361 | |
| 72 | 169 | 266 | 362 | AGA |
| 73 | 170 | 267 | 363 | nnAAC |
| 74 | 171 | 268 | 364 | |
| 75 | 172 | 269 | 365 | |
| 76 | 173 | 270 | 366 | |
| 77 | 174 | 271 | | |
| 78 | 175 | 272 | 367 | |
| 79 | 176 | 273 | 368 | |
| 80 | 177 | 274 | 369 | |
| 81 | 178 | 275 | 370 | |
| 82 | 179 | 276 | 371 | |
| 83 | 180 | 277 | 372 | |
| 84 | 181 | 278 | 373 | |
| 85 | 182 | 279 | 374 | |
| 86 | 183 | 280 | 375 | |
| 87 | 184 | 281 | 376 | |
| 88 | 185 | 282 | 377 | |
| 89 | 186 | 283 | 378 | |
| 90 | 187 | 284 | 379 | |
| 91 | 188 | 285 | 380 | |
| 92 | 189 | 286 | 381 | |
| 93 | 190 | 287 | 382 | |
| 94 | 191 | 288 | 383 | |
| 95 | 192 | 289 | 384 | |
| 96 | 193 | 290 | 385 | |
| 97 | | 291 | 386 | |
| 98 | | 292 | 387 | |

The present invention further provides a method of typing a bacterial or archaeon strain in a sample, comprising amplifying in said sample a region of DNA comprising repetitive sequences that are at least about 80% identical to a nucleotide sequence of SEQ ID NOs:1-98, or a functional fragment thereof, to produce amplified DNA; and typing the bacterial strain based on the amplified DNA. In further embodiments, the method further comprises sequencing the amplified DNA to produce sequence information; and typing the bacterial strain based on the sequence information. In additional embodiments, typing a bacterial strain further comprises contacting the amplified DNA with one or more restriction enzymes capable of cutting the DNA at at least one site to produce restriction fragments; determining the number and/or size of the restriction fragments; and typing the bacterial strain based on the number and/or size of the restriction fragments. "Determining the number and/or size of the restriction fragments" as used herein can mean analyzing the restriction fragments using, for example, agarose gel elextrophoresis and the like as is known in the art.

In still other embodiments, the present invention provides a method of detecting the presence of a *Lactobacillus* spp., *Bifidobacterium* spp., *Kandleria* spp., *Leuconostoc* spp., *Oenococcus* spp., *Pediococcus* spp., *Streptococcus* spp., *Weissella* spp., and/or *Olsenella* spp. in a sample, comprising amplifying in said sample a region of DNA comprising repetitive sequences that are at least about 80% identical to the repetitive sequence encoded by a nucleotide sequence of any of the nucleotide sequences of SEQ ID NOs:1-98, or a functional fragment thereof, to produce amplified DNA, and detecting the amplified DNA.

In some embodiments, amplifying a region of DNA comprises amplifying at least about 20 to about 300 consecutive nucleotides of a region of DNA comprising repetitive sequences. Thus, in some embodiments, amplifying a region of DNA comprises amplifying at least about 20, 25, 23, 35, 40, 45, 50, 55, 60, 65, 70, 75, 80, 85, 90, 95, 100, 110, 120, 130, 140, 150, 160, 170, 180, 190, 200, 210, 220, 230, 240, 250, 260, 270, 280, 290, 300, or more and the like and any range or value therein of consecutive nucleotides of a region of DNA comprising repetitive sequences Any method of amplifying DNA known in the art and later developed can be used with this invention. A nonlimiting example of a method of amplifying includes polymerase chain reaction (PCR) as described herein and as known in the art. In some embodiments of this invention, amplifying a region of DNA comprises amplifying at least a single spacer and two repeat elements on either side of the single spacer in the repeat-spacer region of a *Lactobacillus* spp., *Bifidobacterium* spp., *Kandleria* spp., *Leuconostoc* spp., *Oenococcus* spp., *Pediococcus* spp., *Streptococcus* spp., *Weissella* spp., and/or *Olsenella* spp. In some embodiments of this invention, amplifying a region of DNA comprises amplifying at least about 50, at least about 100, at least about 150, at least about 200, at least about 250, at least about 300, at least about 350 consecutive nucleotides in the repeat-spacer region of a *Lactobacillus* spp., *Bifidobacterium* spp., *Kandleria* spp., *Leuconostoc* spp., *Oenococcus* spp., *Pediococcus* spp., *Streptococcus* spp., *Weissella* spp., and/or *Olsenella* spp.

As would be understood by those of skill in the art, when amplifying a portion of a repeat-spacer region of a *Lactobacillus* spp., *Bifidobacterium* spp., *Kandleria* spp., *Leuconostoc* spp., *Oenococcus* spp., *Pediococcus* spp., *Streptococcus* spp., *Weissella* spp., and/or *Olsenella* spp., any primer pair designed to comprise conserved sequences flanking the repeat-spacer array could be used.

Further embodiments of the invention provide a method of identifying a strain of *Lactobacillus* spp., *Bifidobacterium* spp., *Kandleria* spp., *Leuconostoc* spp., *Oenococcus* spp., *Pediococcus* spp., *Streptococcus* spp., *Weissella* spp., and/or *Olsenella* spp. having resistance to an invasive foreign DNA, comprising correlating the presence of a CRISPR spacer with resistance to said invasive foreign DNA (e.g., phage DNA, plasmid DNA, chromosomal DNA, transposon DNA) in *Lactobacillus* spp., *Bifidobacterium* spp., *Kandleria* spp., *Leuconostoc* spp., *Oenococcus* spp., *Pediococcus* spp., *Streptococcus* spp., *Weissella* spp., and/or *Olsenella* spp. having a CRISPR system; and detecting said CRISPR spacer in said strain of a *Lactobacillus* spp., *Bifidobacterium* spp., *Kandleria* spp., *Leuconostoc* spp., *Oenococcus* spp., *Pediococcus* spp., *Streptococcus* spp., *Weissella* spp., and/or *Olsenella* spp., thereby identifying said strain as comprising said CRISPR spacer and having resistance to said invasive foreign DNA.

As used herein, "correlate," "correlating" and grammatical variations thereof mean to establish or establishing an association, a relationship, or a close connection between two or more things. Thus, for example, correlating can mean establishing an association of the presence of one or more particular spacers in a *Lactobacillus* spp., *Bifidobacterium* spp., *Kandleria* spp., *Leuconostoc* spp., *Oenococcus* spp., *Pediococcus* spp., *Streptococcus* spp., *Weissella* spp., and/or *Olsenella* spp. strain exhibiting resistance to particular invasive foreign DNA. In the context of identifying a *Lactobacillus* spp., *Bifidobacterium* spp., *Kandleria* spp., *Leuconostoc* spp., *Oenococcus* spp., *Pediococcus* spp., *Streptococcus* spp., *Weissella* spp., and/or *Olsenella* spp., "correlating" means amplifying spacer sequences in a resistant strain of *Lactobacillus* spp., *Bifidobacterium* spp., *Kandleria* spp., *Leuconostoc* spp., *Oenococcus* spp., *Pediococcus* spp., *Streptococcus* spp., *Weissella* spp., and/or *Olsenella* spp., sequencing the amplified spacer sequences and identifying the origin of the spacer sequence by aligning the amplified spacer sequence with protospacer sequences from invasive foreign genomes.

In representative embodiments, detecting comprises amplifying the DNA of said strain of *Lactobacillus* spp., *Bifidobacterium* spp., *Kandleria* spp., *Leuconostoc* spp., *Oenococcus* spp., *Pediococcus* spp., *Streptococcus* spp., *Weissella* spp., and/or *Olsenella* spp. using amplification primers for amplifying the CRISPR spacer correlated with resistance, to produce a CRISPR spacer amplicon when said CRISPR spacer is present, thereby detecting the presence or absence of said CRISPR spacer amplicon.

Methods of visualizing or detecting the presence or absence of a CRSIPR spacer amplicon are well-known in the art and include, for example, gel electrophoresis, sequencing, hybridization and the like.

Other embodiments of the invention provide methods for modifying resistance of a bacterium or an archaeon to an invasive foreign DNA that comprises a target DNA, comprising introducing into cells of said bacterium or archaeon a heterologous nucleic acid molecule comprising, consisting essentially of, or consisting of a first and a second CRISPR repeat from *Lactobacillus* spp., *Bifidobacterium* spp., *Kandleria* spp., *Leuconostoc* spp., *Oenococcus* spp., *Pediococcus* spp., *Streptococcus* spp., *Weissella* spp., and/or *Olsenella* spp. and a CRISPR spacer, wherein the spacer is homologous to at least a portion of the invasive foreign DNA and is located 3' of the first CRISPR repeat and 5' of the second CRISPR repeat to produce transformed bacterial or archaea cells, and selecting transformed bacterial or archaea cells having modified resistance to said invasive foreign DNA.

As used herein "modifying the resistance" means conferring or increasing resistance in a bacterium or an archaeon to a particular invasive foreign DNA. If the bacterium or archaeon did not have any resistance to the particular invasive foreign DNA prior to the modification, then resistance is conferred upon the bacteria to said invasive foreign DNA by introducing the heterologous nucleic acid molecule of the invention into the cells of said bacterium or archaeaon, thereby providing a level of resistance to said invasive foreign DNA that is greater than that observed to said invasive foreign DNA in a control (e.g., a control bacterium or archaeaon not comprising said heterologous nucleic acid molecule of the invention). However, if the bacterium or archaeon displayed some level of resistance to said invasive foreign DNA prior to the modification, by introducing the heterologous nucleic acid molecule of the invention into the cells of said bacterium or archaeon, the level of resistance to said invasive foreign DNA in said bacterium or archaeon can be increased as compared to the level of resistance to said invasive foreign DNA in a control bacterium or archaeon (e.g., a bacterium or an archaeon not comprising the heterologous nucleic acid molecule of the invention). In representative embodiments, the bacterium to which resistance to a particular invasive foreign DNA can be modified can be *Lactobacillus* spp., *Bifidobacterium* spp., *Kandleria* spp., *Leuconostoc* spp., *Oenococcus* spp., *Pediococcus* spp., *Streptococcus* spp., *Weissella* spp., and/or *Olsenella* spp.

In some embodiments, the first and second CRISPR repeats of the heterologous nucleic acid molecule comprise, consist essentially of, or consist of at least about 10 consecutive nucleotides of a repeat from a *Lactobacillus* spp., *Bifidobacterium* spp., *Kandleria* spp., *Leuconostoc* spp., *Oenococcus* spp., *Pediococcus* spp., *Streptococcus* spp., *Weissella* spp., and/or *Olsenella* spp. and the CRISPR spacer comprises, consists essentially of, or consists of at least about 10 consecutive nucleotides of the invasive foreign DNA. In some embodiments, the first and second CRISPR repeats comprise, consist essentially of, or consist of a nucleotide sequence of any of the nucleotide sequences of SEQ ID NOs:1-98, a functional fragment thereof, or any combination thereof. In other embodiments, the spacer sequence can be at least about 80% identical to the at least a portion of the invasive foreign DNA. In still other embodiments, at least about 10 consecutive nucleotides at the 3' end of the CRISPR spacer can be 100% identical to the at least a portion of the invasive foreign DNA.

In some embodiments, bacteria and archaea that can be typed, detected, identified or modified using methods of this invention include, but are not limited to, those from the genera of *Lactobacillus* spp., *Bifidobacterium* spp., *Kandleria* spp., *Leuconostoc* spp., *Oenococcus* spp., *Pediococcus* spp., *Streptococcus* spp., *Weissella* spp., and/or *Olsenella* spp. In other embodiments, the bacteria and/or archaea that can be typed, detected, identified or modified using the methods of this invention, include but are not limited to *Bifidobacterium bombi*, *Bifidobacterium dentium* LMG 11045, *Bifidobacterium merycicum* LMG 11341, *Kandleria vitulina* DSM 20405, *Lactobacillus agilis* DSM 20509, *Lactobacillus animalis* DSM 20602, *Lactobacillus apodemi* DSM 16634, *Lactobacillus brevis* subsp *gravensis* ATCC 27305, *Lactobacillus buchneri* CD034, *Lactobacillus buchneri* DSM 20057, *Lactobacillus cacaonum* DSM 21116, *Lactobacillus casei* str Zhang, *Lactobacillus ceti* DSM 22408, *Lactobacillus coryniformis* subsp *coryniformis* KCTC 3167, *Lactobacillus coryniformis torquens*, *Lactobacillus crispatus* FB049-03, *Lactobacillus curvatus* CRL 705, *Lactobacillus delbrueckii* subsp *lactis* CRL 581, *Lactobacillus delbrueckii jakobsenii* DSM 26046, *Lactobacillus diolivorans* DSM 14421, *Lactobacillus farciminis* DSM 20184, *Lactobacillus fermentum* DSM 20055, *Lactobacillus floricola* DSM 23037A, *Lactobacillus floricola* DSM 23037B, *Lactobacillus fuchuensis* DSM 14340, *Lactobacillus futsaii* JCM 17355, *Lactobacillus gasseri* K7, *Lactobacillus graminis* DSM 20719, *Lactobacillus hammesii* DSM 16381, *Lactobacillus hominis* CRBIP, *Lactobacillus hordei* DSM 19519A, *Lactobacillus hordei* DSM 19519B, *Lactobacillus jensenii* DSM 20557, *Lactobacillus johnsonii* DPC 6026, *Lactobacillus lindneri* DSM 20690, *Lactobacillus mali* ATCC 27304, *Lactobacillus mindensis* DSM 14500, *Lactobacillus mucosae* DSM 13345, *Lactobacillus namurensis* DSM 19117, *Lactobacillus nantensis* DSM 16982, *Lactobacillus nodensis* DSM 19682A, *Lactobacillus nodensis* DSM 19682B, *Lactobacillus oligofermentans*

DSM 15707, *Lactobacillus otakiensis* DSM 19908, *Lactobacillus ozensis* DSM 23829, *Lactobacillus paracasei* subsp *paracasei* 8700:2, *Lactobacillus paracasei* subsp *tolerans* Lpl7, *Lactobacillus paracollinoides* DSM 15502, *Lactobacillus parakfiri* DSM 10551, *Lactobacillus pentosus* KCA1, *Lactobacillus pentosus* IG1, *Lactobacillus plantarum* EGD-AQ4, *Lactobacillus psittaci* DSM 15354, *Lactobacillus rennini* DSM 20253, *Lactobacillus reuteri* mlc3, *Lactobacillus rhamnosus* GG, *Lactobacillus rossiae* DSM 15814, *Lactobacillus ruminis* ATCC 25644, *Lactobacillus sakei carnosus* DSM 15831, *Lactobacillus salivarius* UCC 118, *Lactobacillus sanfranciscensis* DSM 20451, *Lactobacillus saniviri* DSM 24301, *Lactobacillus senmaizukei* DSM 21775, *Lactobacillus tucceti* DSM 20183, *Lactobacillus versmoldensis* DSM 14857, *Lactobacillus zymae* DSM 19395, *Leuconostoc gelidum* JB7, *Leuconostoc pseudomesenteroides* 4882, *Oenococcus kitaharae* DSM 17330, *Pediococcus inopinatus* DSM 20285, *Pediococcus lolii* DSM 19927, *Pediococcus parvulus* DSM 20332A, *Pediococcus parvulus* DSM 20332B, *Pediococcus stilesii* DSM 18001, *Streptococcus agalactiae* GB00300, *Streptococcus gallolyticus* ATCC BAA-2069, *Streptococcus henryi* DSM 19005, *Streptococcus mutans* NLML5, *Streptococcus oralis* SK304, *Streptococcus anginosus* 1_2_62CV, *Streptococcus anginosus* DSM 20563, *Streptococcus dysagalactiae* subsp *equisimilis*, *Streptococcus equi* subsp *zooepidemicus*, *Streptococcus gordonii* Challis substr CH1, *Streptococcus infantarius* subsp *infantarius*, *Streptococcus intermedius* B196, *Streptococcus lutetiensis* 033, *Streptococcus mitis* SK321, *Streptococcus mutans* UA 159, *Streptococcus orisratti* DSM 15617, *Streptococcus parasanguinis* F0449, *Streptococcus salivarius* K12, *Streptococcus sanguinis* SK330, *Streptococcus vestibularis* ATCC 49124, *Lactobacillus composti* DSM 18527, *Lactobacillus concavus* DSM 17758, *Lactobacillus secaliphilus* DSM 17896, *Weissella halotolerans* DSM 20190, *Weissella kandleri* DSM 20593, and/or *Olsenella uli*

The invention will now be described with reference to the following examples. It should be appreciated that these examples are not intended to limit the scope of the claims to the invention, but are rather intended to be exemplary of certain embodiments. Any variations in the exemplified methods that occur to the skilled artisan are intended to fall within the scope of the invention.

EXAMPLES

Example 1

Characterization of CRISPR Repeat, tracrRNA, Cas9 Polypeptide and PAM Sequences from Different Species and Strains of Bacteria and Archaea CRISPR repeat, tracrRNA, Cas9 polypeptide and PAM sequences were isolated from different species and strains of bacteria and archae. The list of bacterial/archaea species/strains from which at least a CRISPR repeat (e.g., SEQ ID NOs:1-98), tracrRNA sequence (e.g., SEQ ID NOs:99-193), Cas9 polypeptide sequence (e.g., SEQ ID NOs:194-293), or a PAM sequence (Table 3, below) was isolated is provided in Table 2, below.

TABLE 2

Bacteria and Archaea species and strains of this study

*Bifidobacterium bombi*
*Bifidobacterium dentium* LMG 11045
*Bifidobacterium merycicum* LMG 11341

TABLE 2-continued

Bacteria and Archaea species and strains of this study

*Kandleria vitulina* DSM 20405
*Lactobacillus agilis* DSM 20509
*Lactobacillus animalis* DSM 20602
*Lactobacillus apodemi* DSM 16634
*Lactobacillus brevis* subsp *gravensis* ATCC 27305
*Lactobacillus buchneri* CD034
*Lactobacillus buchneri* DSM 20057
*Lactobacillus cacaonum* DSM 21116
*Lactobacillus casei* str Zhang
*Lactobacillus ceti* DSM 22408
*Lactobacillus coryniformis* subsp *coryniformis* KCTC 3167
*Lactobacillus coryniformis torquens*
*Lactobacillus crispatus* FB049-03
*Lactobacillus curvatus* CRL 705
*Lactobacillus delbrueckii* subsp *lactis* CRL 581
*Lactobacillus delbrueckii jakobsenii* DSM 26046
*Lactobacillus diolivorans* DSM 14421
*Lactobacillus farciminis* DSM 20184
*Lactobacillus fermentum* DSM 20055
*Lactobacillus floricola* DSM 23037A
*Lactobacillus floricola* DSM 23037B
*Lactobacillus fuchuensis* DSM 14340
*Lactobacillus futsaii* JCM 17355
*Lactobacillus gasseri* K7
*Lactobacillus graminis* DSM 20719
*Lactobacillus hammesii* DSM 16381
*Lactobacillus hominis* CRBIP
*Lactobacillus hordei* DSM 19519A
*Lactobacillus hordei* DSM 19519B
*Lactobacillus jensenii* DSM 20557
*Lactobacillus johnsonii* DPC 6026
*Lactobacillus lindneri* DSM 20690
*Lactobacillus mali* ATCC 27304
*Lactobacillus mindensis* DSM 14500
*Lactobacillus mucosae* DSM 13345
*Lactobacillus namurensis* DSM 19117
*Lactobacillus nantensis* DSM 16982
*Lactobacillus nodensis* DSM 19682A
*Lactobacillus nodensis* DSM 19682B
*Lactobacillus oligofermentans* DSM 15707
*Lactobacillus otakiensis* DSM 19908
*Lactobacillus ozensis* DSM 23829
*Lactobacillus paracasei* subsp *paracasei* 8700:2
*Lactobacillus paracasei* subsp *tolerans* Lpl7
*Lactobacillus paracollinoides* DSM 15502
*Lactobacillus parakefiri* DSM 10551
*Lactobacillus pentosus* KCA1
*Lactobacillus pentosus* IG1
*Lactobacillus plantarum* EGD-AQ4
*Lactobacillus psittaci* DSM 15354
*Lactobacillus rennini* DSM 20253
*Lactobacillus reuteri* mlc3
*Lactobacillus rhamnosus* GG
*Lactobacillus rossiae* DSM 15814
*Lactobacillus ruminis* ATCC 25644
*Lactobacillus sakei carnosus* DSM 15831
*Lactobacillus salivarius* UCC 118
*Lactobacillus sanfranciscensis* DSM 20451
*Lactobacillus saniviri* DSM 24301
*Lactobacillus senmaizukei* DSM 21775
*Lactobacillus tucceti* DSM 20183
*Lactobacillus versmoldensis* DSM 14857
*Lactobacillus zymae* DSM 19395
*Leuconostoc gelidum* JB7
*Leuconostoc pseudomesenteroides* 4882
*Oenococcus kitaharae* DSM 17330
*Pediococcus inopinatus* DSM 20285
*Pediococcus lolii* DSM 19927
*Pediococcus parvulus* DSM 20332A
*Pediococcus parvulus* DSM 20332B
*Pediococcus stilesii* DSM 18001
*Steptococcus agalactiae* GB00300
*Steptococcus gallolyticus* ATCC BAA-2069
*Steptococcus henryi* DSM 19005
*Steptococcus mutans* NLML5

TABLE 2-continued

Bacteria and Archaea species and strains of this study

Steptococcus oralis SK304
Streptococcus anginosus 1_2_62CV
Streptococcus anginosus DSM 20563
Streptococcus dysagalactiae subsp equisimilis
Streptococcus equi subsp zooepidemicus
Streptococcus gordonii Challis substr CH1
Streptococcus infantarius subsp infantarius
Streptococcus intermedius B196
Streptococcus lutetiensis 033
Streptococcus mitis SK321
Streptococcus mutans UA 159
Streptococcus orisratti DSM 15617
Streptococcus parasanguinis F0449
Streptococcus salivarius K12
Streptococcus sanguinis SK330
Streptococcus vestibularis ATCC 49124
Lactobacillus composti DSM 18527
Lactobacillus concavus DSM 17758
Lactobacillus secaliphilus DSM 17896
Weissella halotolerans DSM 20190
Weissella kandleri DSM 20593
Olsenella uli

TABLE 3

PAM consensus sequences recognized by the CRISPR-Cas system of the listed organism

| Organism | PAM |
| --- | --- |
| Bifidobacterium merycicum | nGG |
| Lactobacillus jensenii | nGG |
| Lactobacillus rhamnosus | nGAAA |
| Lactobacillus animalis | nnG |
| Lactobacillus casei | nGA |
| Lactobacillus pentosus KCA1 | nnG |
| Lactobacillus gasseri | nTAA |
| Oenococcus kitaharae | nTG |
| Bifidobacterium bombi | nnC |
| Pediococcus parvulus B | nnAAC |
| Pediococcus parvulus A | AGA |
| Lactobacillus cacaonum | nnnAnnA |
| Lactobacillus mali | nnAnAA |
| Lactobacillus buchneri | nnAAAA |

Figure 7:
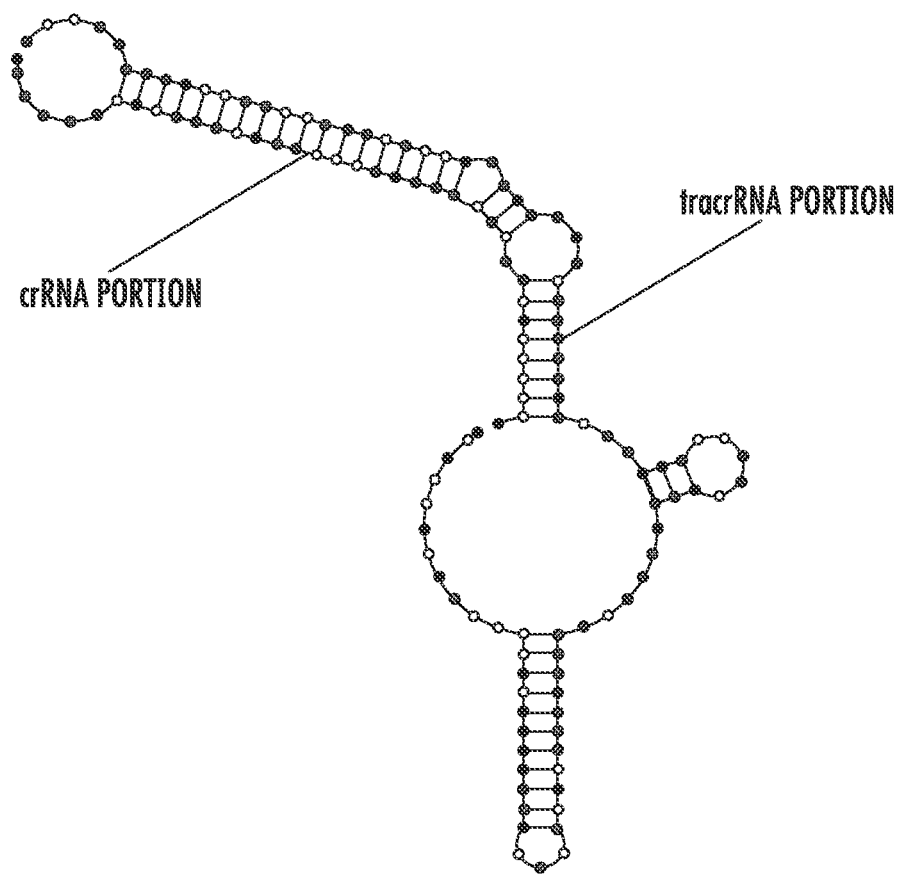
FIG. 7 shows the predicted secondary structure of a single guide RNA (sgRNA) (crRNA-tracrRNA) from *Streptococcus anginosus* in which the crRNA and tracrRNA portions of the sgRNA are noted.
Figure 8:
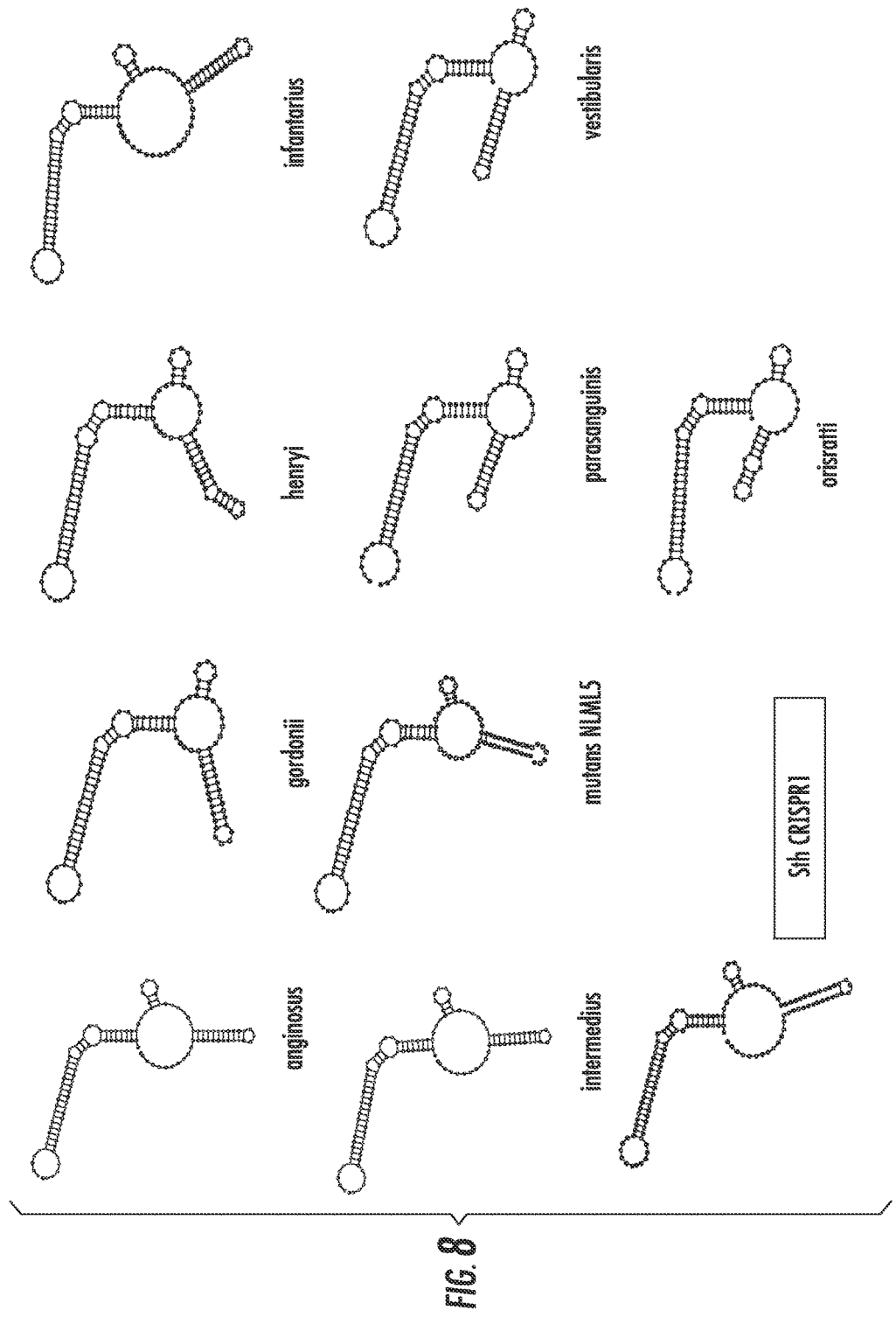
FIG. 8 shows predicted secondary structure of the single guide RNAs (sgRNAs) (crRNA-tracrRNA) from ten different *Streptococcus* species/strains including that from *Streptococcus thermophilus* CRISPR1.
Figure 9:
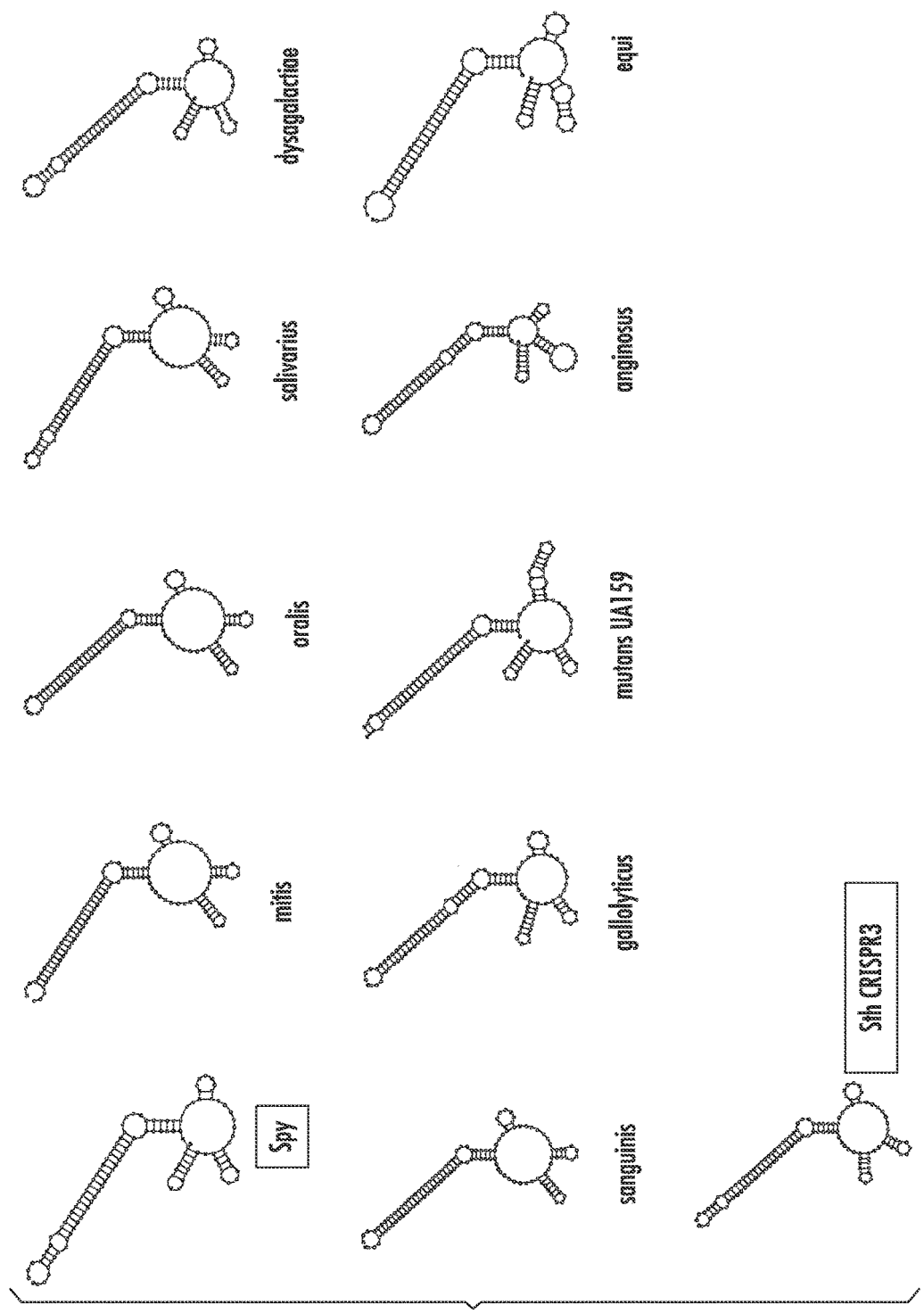
FIG. 9 shows predicted secondary structure of the single guide RNAs (sgRNAs) (crRNA-tracrRNA) from eleven different *Streptococcus* species/strains including that from *Streptococcus thermophilus* CRISPR3.
Figure 10:
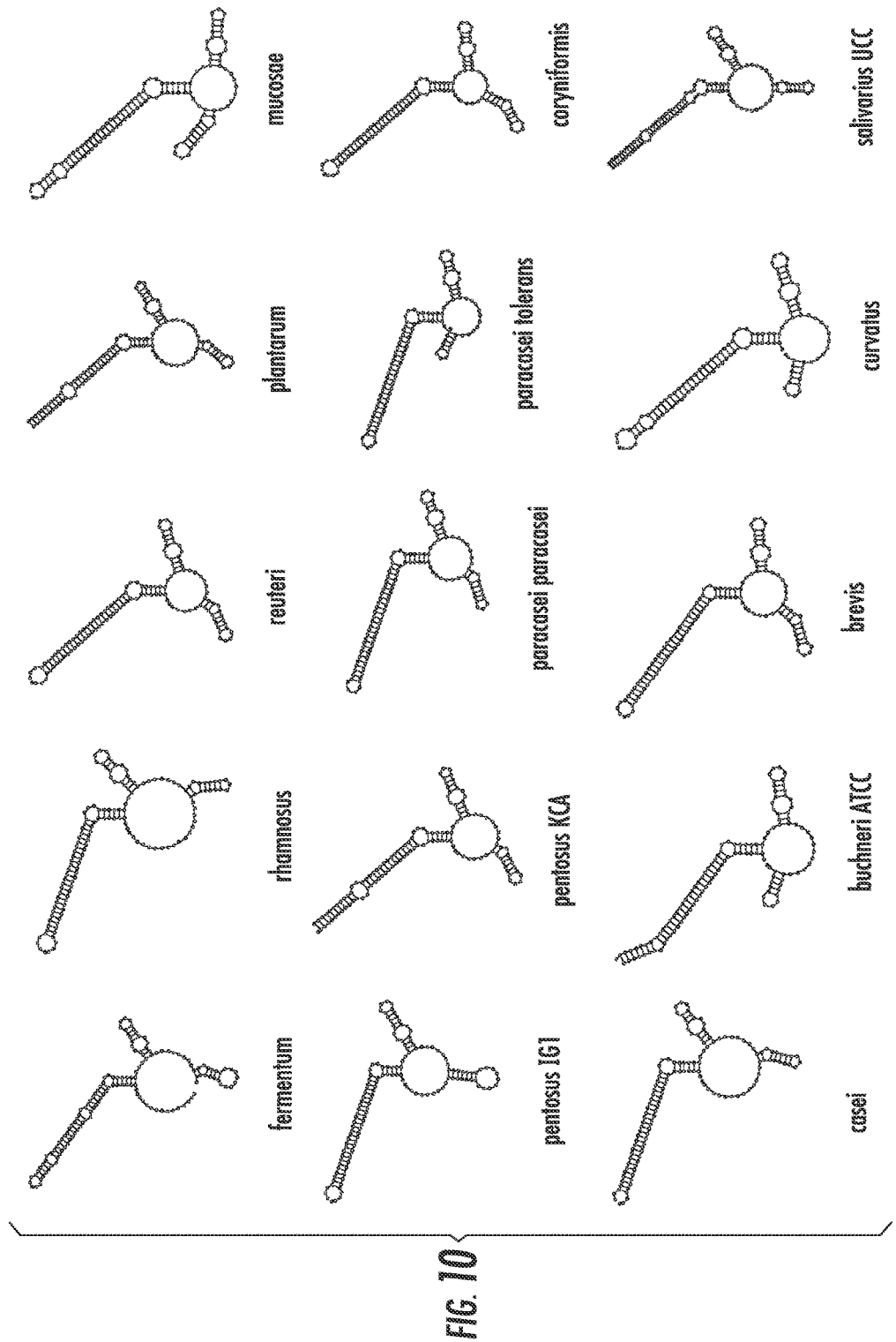
FIG. 10 shows predicted secondary structure of the single guide RNAs (sgRNAs) (crRNA-tracrRNA) from fifteen different *Lactobacillus* species/strains.
Figure 11:
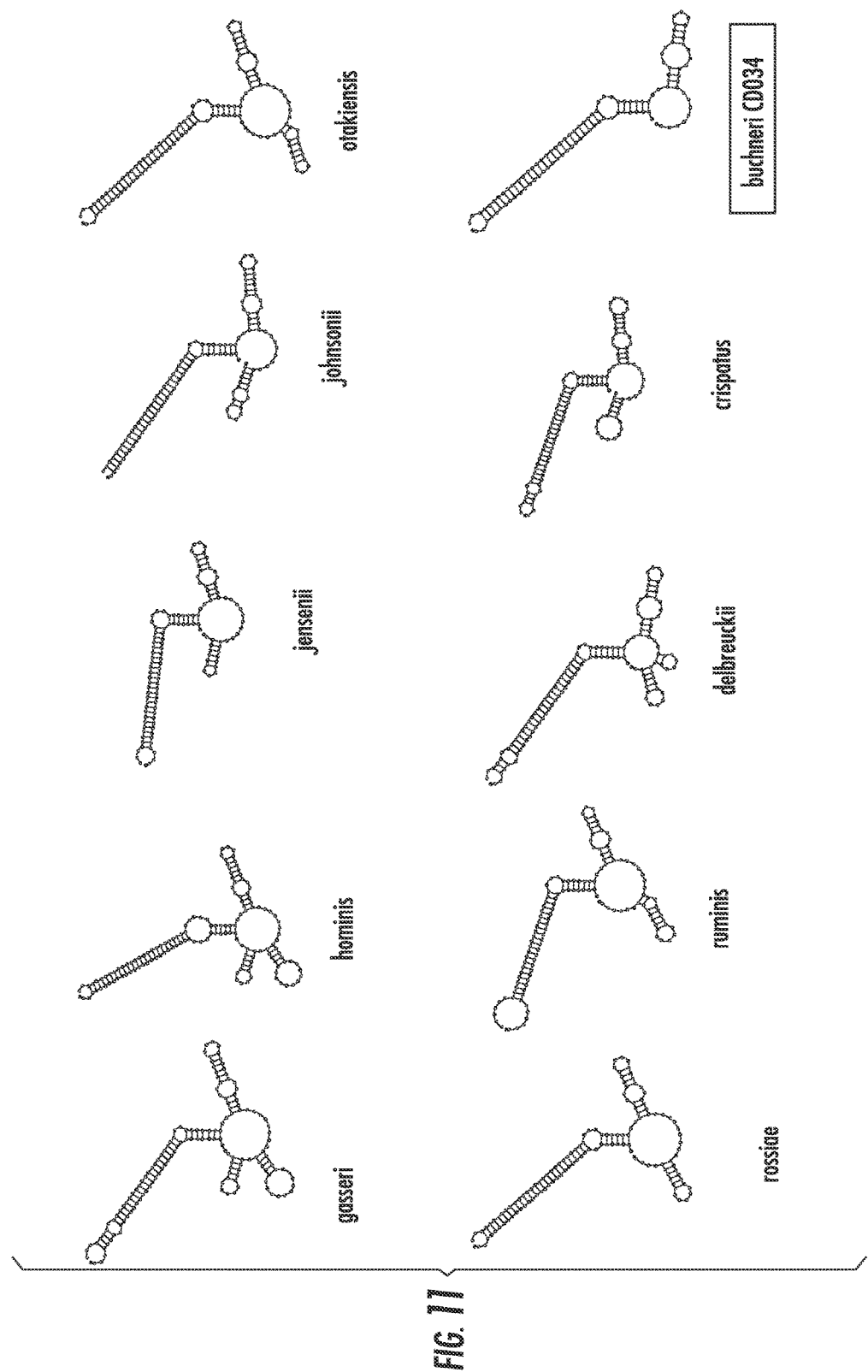
FIG. 11 shows predicted secondary structure of the single guide RNAs (sgRNAs) (crRNA-tracrRNA) from ten different *Lactobacillus* species/strains.
Figures 12A, 12B:
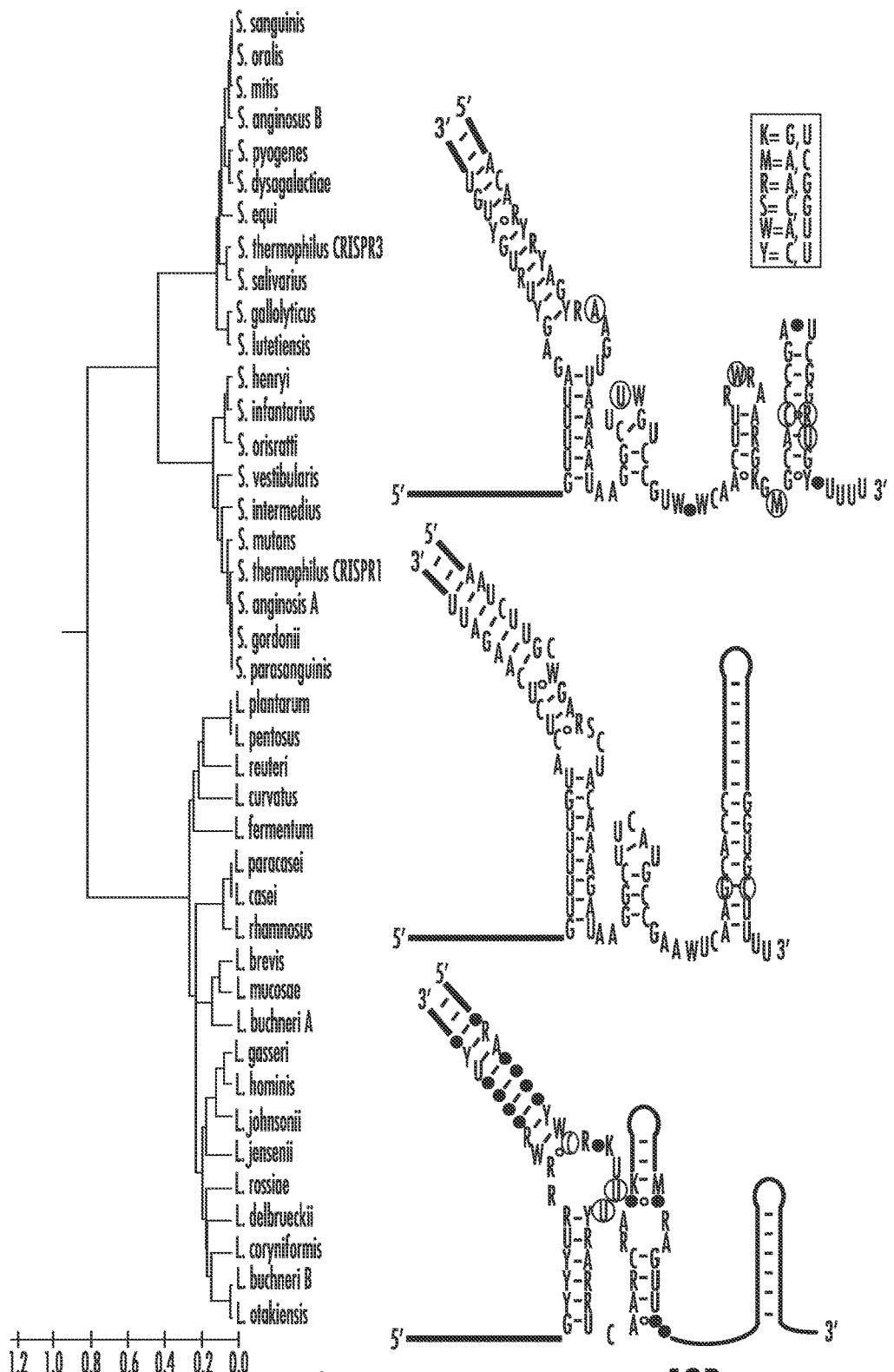
FIGS. 12A-12B shows the Cas9:sgRNA families.

The predicted secondary structures of the single guide RNAs (sgRNAs) (crRNA-tracrRNA) from *Streptococcus* species/strains are provided in FIGS. 7-9 and the predicted secondary structures of the sgRNAs from *Lactobacillus* species/strains are provided in FIG. 10 and FIG. 11. FIG. 7 is an enlargement of the predicted secondary structure of a sgRNA from *S. anginosus*, in which the crRNA and tracrRNA portions of the sgRNA are pointed out. The crRNA and tracrRNA portions of each of the sgRNAs provided in FIGS. 7-11 can be similarly identified.

Upon isolation of the various components of the CRISPR-Cas system from each of the above identified bacteria/archaea, a phylogenetic comparison was done and the relatedness is provided in FIGS. 12-15. Specifically, FIG. 12A provides a phylogenetic tree based on Cas9 protein sequences from various *Streptococcus* and *Lactobacillus* species, which shows that the sequences cluster into three families. A. consensus sequence and secondary structure of a predicted consensus guide RNA for each family is shown in FIG. 12B. Conservation of the overall sgRNA.crRNA/-tracrRNA structure is observed between families and high levels of sequence conservation is observed within clusters. The presence of a bulge with a directional kink between the lower stem and the upper stem was observed consistently across a diversity of systems (FIG. 12B). The length of the lower stem was highly conserved within, and variable between families. Interestingly, the highest level of conservation was observed for the nexus sequences (FIG. 12B). The general nexus shape with a GC-rich stem and an offset uracil was shared between the two *Streptococcus* families. In contrast, the idiosyncratic double stem nexus (FIG. 12B) was unique to, and ubiquitous in, *Lactobacillus* systems. Remarkably, some bases within the nexus were strictly conserved even between distinct families, including A52 and C55, further highlighting the critical role of this module. Based on the SpyCas9 crystal structure (Nishimashu et al. *Cell* 156:935-939 (2014)), A52 interacts with the backbone of residues 1103-1107 close to the 5' end of the target strand, suggesting that the interaction of the nexus with the protein backbone may be required for PAM binding. Furthermore, the structure of SpyCas9 with target DNA shows that this region of the protein directly interacts with the PAM in duplex form, and suggests a role for the nexus in presenting this region of the protein in an appropriate conformation to engage double-stranded DNA.

Figure 14:
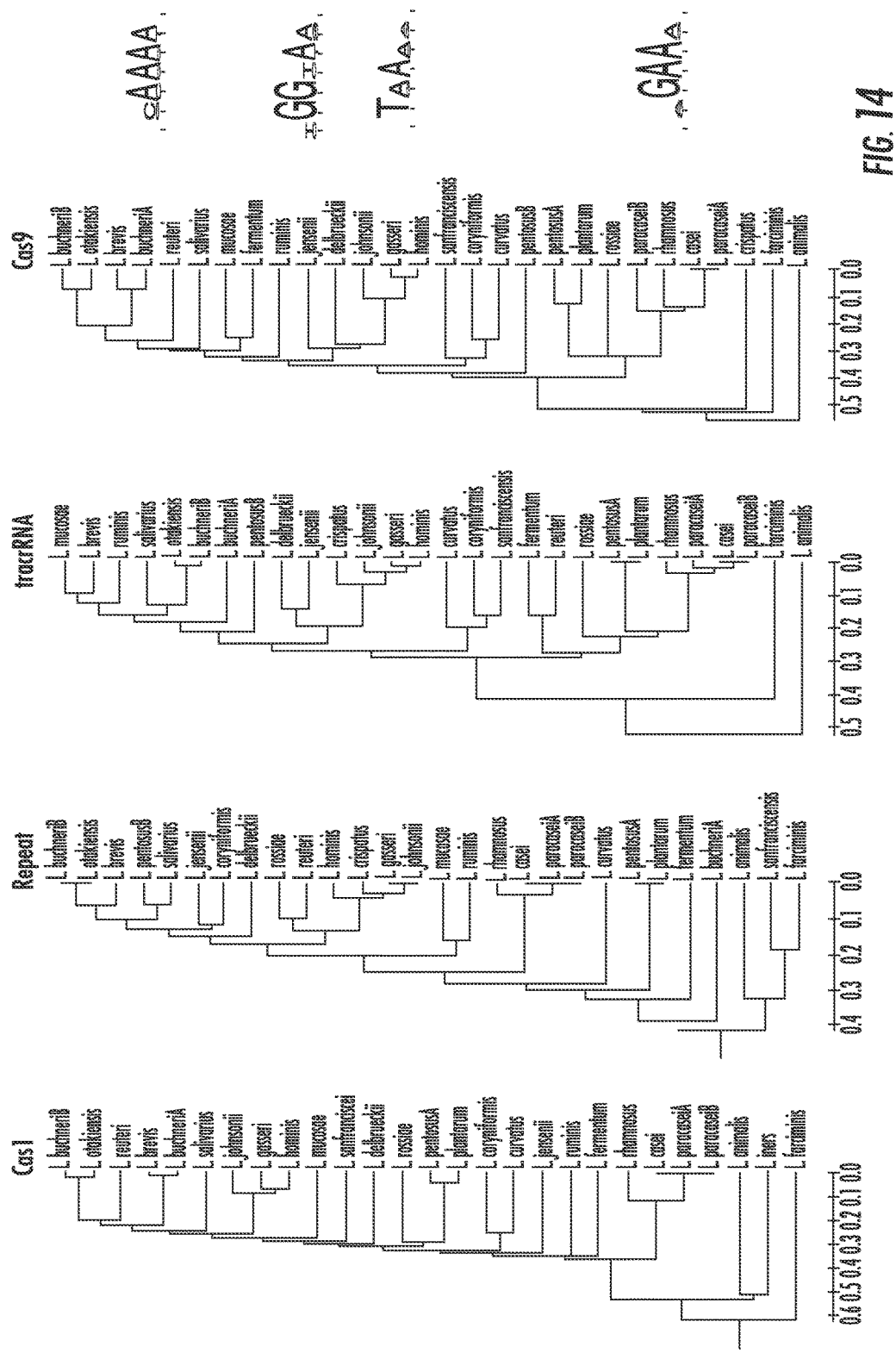
FIG. 14 shows congruence between Cas1 (left), tracrRNA (middle left), CRISPR repeat (middle right) and Cas9 (right) sequence clustering.

The congruence between tracrRNA (left), CRISPR repeat (middle) and Cas9 (right) sequence clustering is provided in FIG. 13, which shows consistent grouping into three families across the three sequence-based phylogenetic trees. FIG. 14 shows a congruence between Cas1 (left), tracrRNA (middle left), CRISPR repeat (middle right) and Cas9 (right) sequence clustering.

Figure 15:
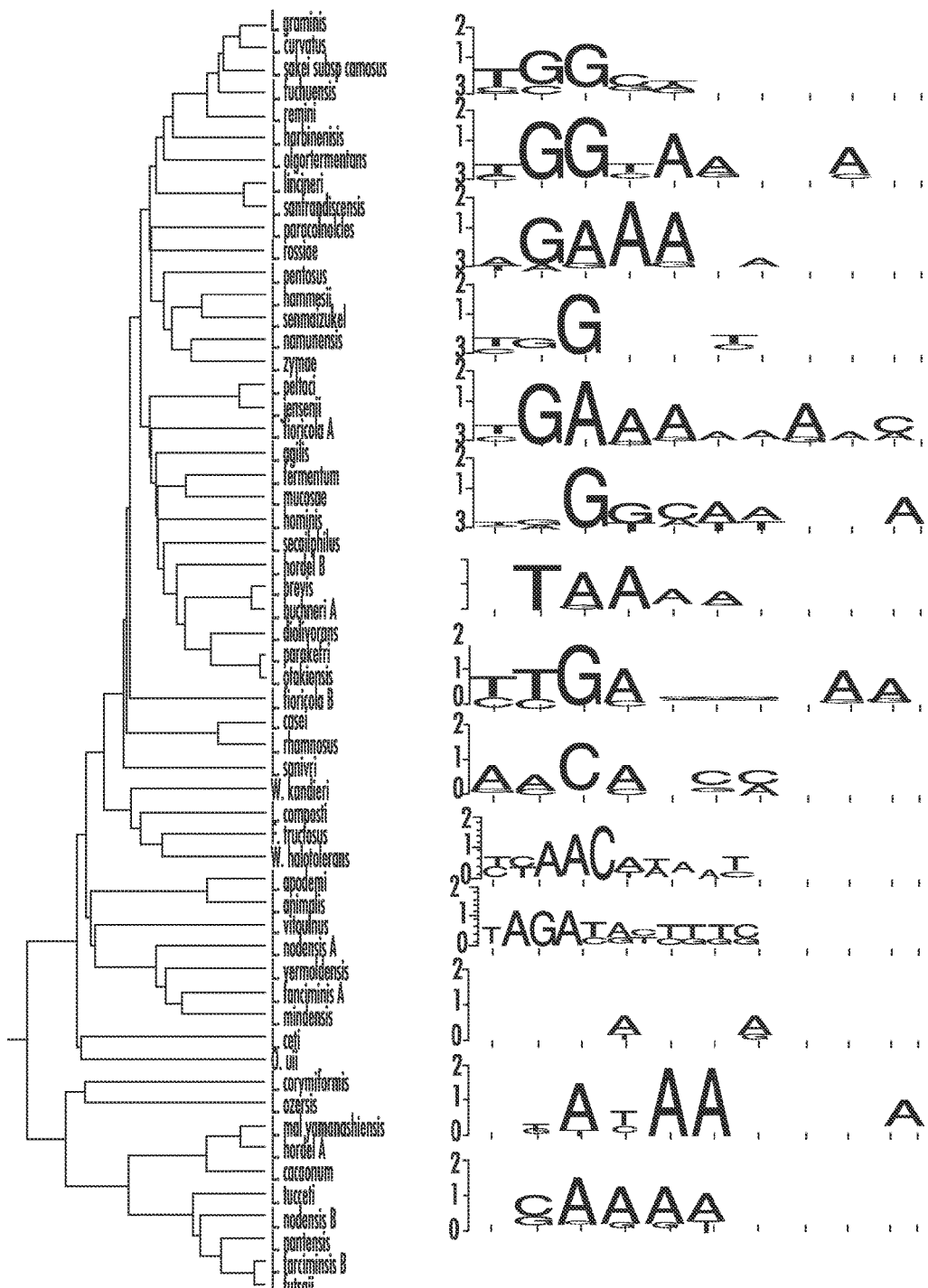
FIG. 15 shows Cas9 polypeptides from various bacteria and archeae species/strains in combination with protospacer adjacent motifs (PAM; SEQ ID NOs:472-474).

Cas9 polypeptides from the various bacteria and archeae species/strains were also grouped according to their corresponding protospacer adjacent motifs (PAM) (left, FIG. 15). Consensus sequences for the PAM are provided on the right half of FIG. 15.

Thus, with the knowledge of the specific structures and relatedness of the various nucleotide sequences and polypeptide sequences of the CRISPR-Cas systems as described herein, new and diverse synthetic sgRNAs, chimeric RNAs and protein-RNA complexes can be constructed, which can be used for, for example, specific targeting and cleaving of target DNA, editing of target DNA (e.g., generating altered genotypes), transcriptional control of target genes (repression and activation) and/or DNA labeling. Specifically, chimeric guide RNAs can be constructed from the tracrRNA sequences and crRNA sequences in various combinations, swapping out one or more portions of sequences from one (or more) species with portions of sequences from another species, to produce a multitude of different guides functional with one or more Cas9 polypeptide(s) and PAMs, thereby providing increased flexibility and optimization of sgRNA composition and design for different needs.

Example 2

Predicting Orthogonal Groups

Figure 16:
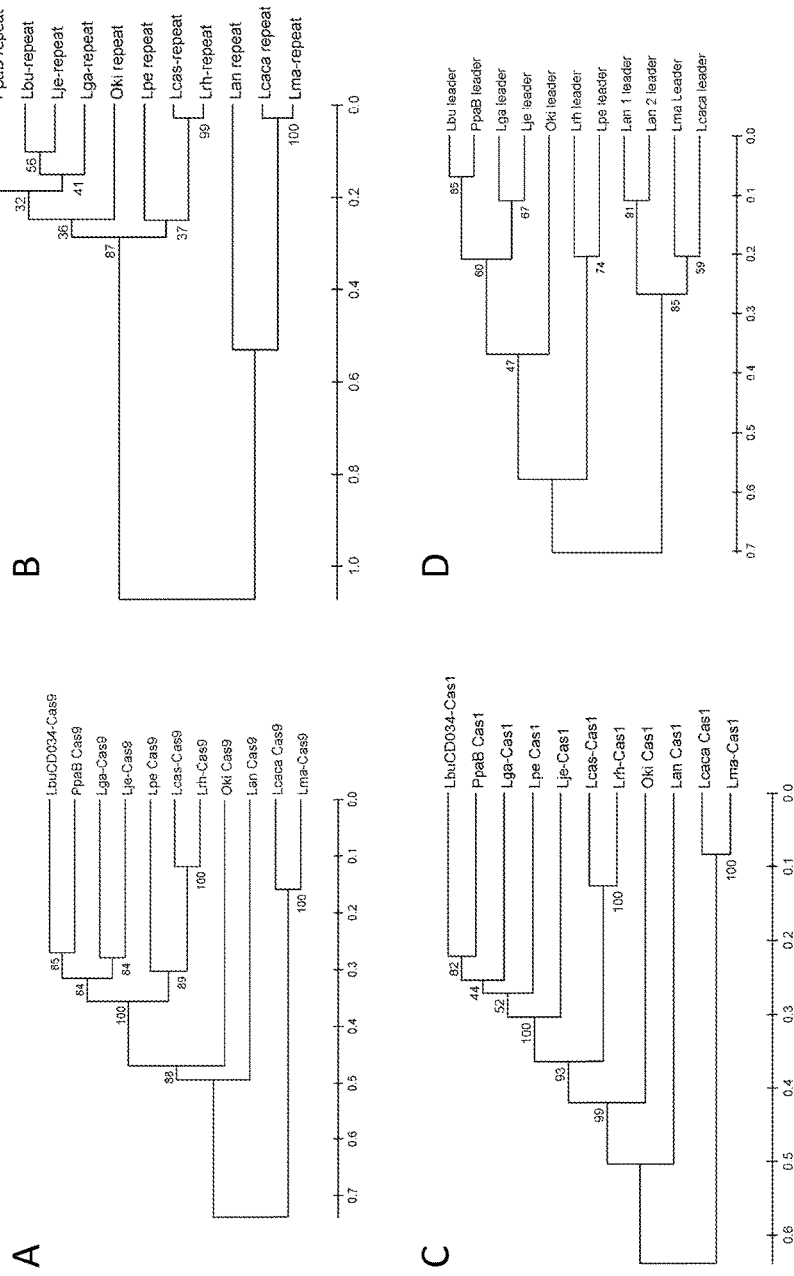
FIG. 16 shows trees to predict orthogonal groups. The three letter code for each organism is as follows: Lbu (*Lacotbacillus buchneri*), PpaB (*Pediococcus parvulus*), Lga (*Lactobacillus gasseri*), Lje (*Lactobacillus jensenii*), Lpe (*Lactobacillus pentosus*), Lcas (*Lactobacillus casei*), Lrh (*Lactobacillus rhamnosus*), Oki (*Oenococcus kitaharae*), Lan (*Lactobacillus animalis*), Lcaca (*Lactobacillus cacaonum*), and Lma (*Lactobacillus mali*). Panel A is a Neighbor-joining tree from a MUSCLE alignment of the Cas9 protein sequences from 11 organisms of interest. The groups were used to determine which Cas9 proteins are more closely related and which are more distantly related to determine potential orthogonal systems. Panel B is a Neighbor-joining tree from a Clustal alignment of the CRISPR repeat nucleotide sequences from 11 organisms of interest. The groups were used to determine which CRISPR repeats are more closely related and which are more distantly related to determine potential orthogonal systems. Panel C is a Neighbor-joining tree from a MUSCLE alignment of the Cas1 protein sequences from 11 organisms of interest. The groups were used to determine which Cas1 proteins are more closely related and which are more distantly related to determine potential orthogonal systems. Panel D is a Neighbor-joining tree from a Clustal alignment of the repeat-spacer array leader nucleotide sequences from 11 organisms of interest. The groups were used to determine which leader sequences are more closely related and which are more distantly related to determine potential orthogonal systems.

FIG. 16 shows trees to predict orthogonal groups. Panel A of FIG. 16 provides a Neighbor-joining tree from a MUSCLE alignment of the Cas9 protein sequences from 11 organisms of interest. Panel B provides a Neighbor-joining tree from a Clustal alignment of the CRISPR repeat nucleotide sequences from 11 organisms of interest and Panel C provides a Neighbor-joining tree from a MUSCLE alignment of the Cas1 protein sequences from 11 organisms of interest. systems. Panel D provides a Neighbor-joining tree from a Clustal alignment of the repeat-spacer array leader nucleotide sequences from 11 organisms of interest. The groups were used to determine which leader sequences are more closely related and which are more distantly related to determine potential orthogonal systems.

The groups in Panels A, B, C and D of FIG. 16 were used to determine within each of Cas9 proteins, CRISPR repeat nucleotide sequences, Cas1 proteins and repeat-spacer array leader nucleotide sequences, respectively, which proteins or nucleotide sequences are more closely related and which are more distantly related in order to determine potential orthogonal systems.

Figure 17:
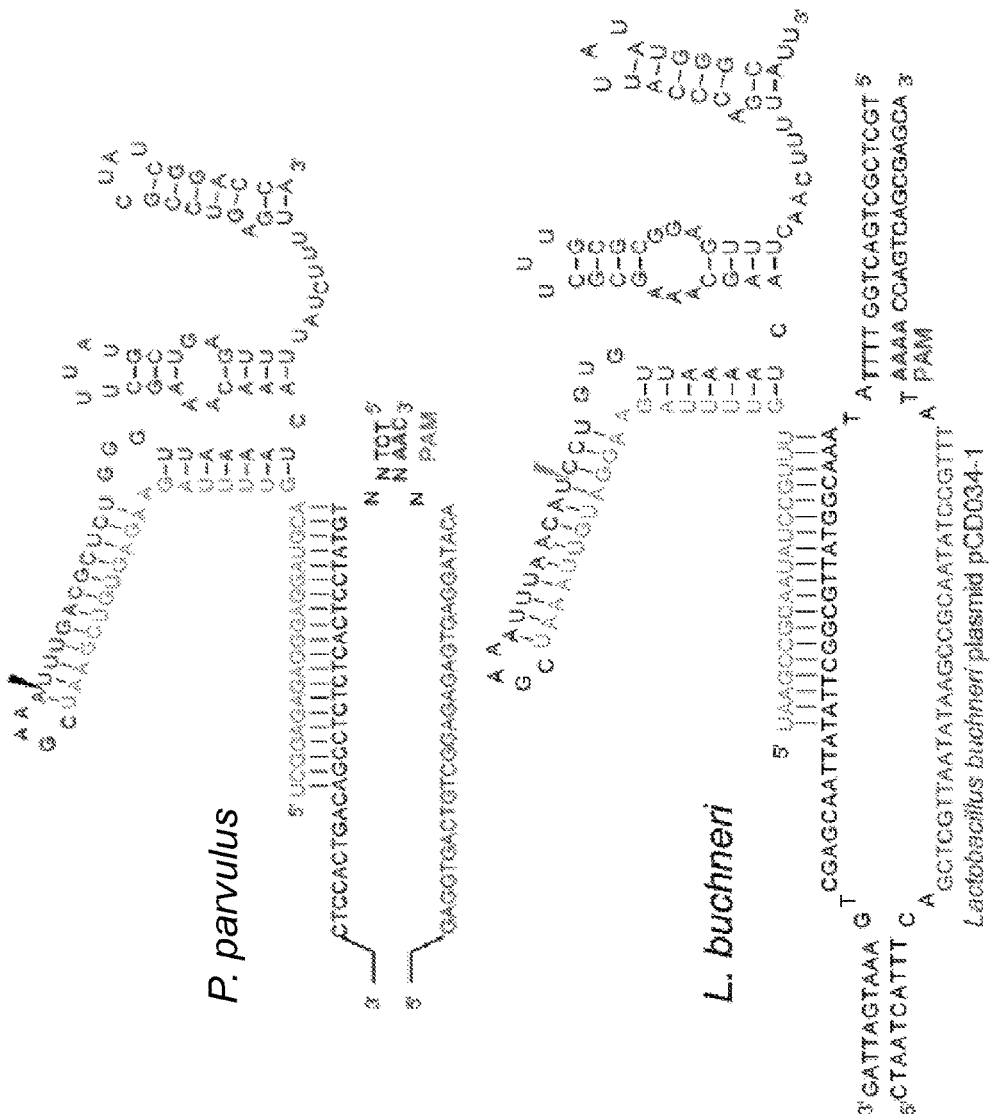
FIG. 17 shows the native tracrRNA:crRNA duplexes that have been combined into single guide RNAs for ease of visualization. The sequences were confirmed via RNA Seq and the structures were predicted using RNA folding software (Upper panel: *Pediococcus parvulus* sgRNA: guide SEQ ID NO:389, target top SEQ ID NO:390, target bottom SEQ ID NO:391; Lower panel: *Lactobacillus buchneri* sgRNA: guide SEQ ID NO:392, target top SEQ ID NO:393, target bottom SEQ ID NO:394).
Figure 18:
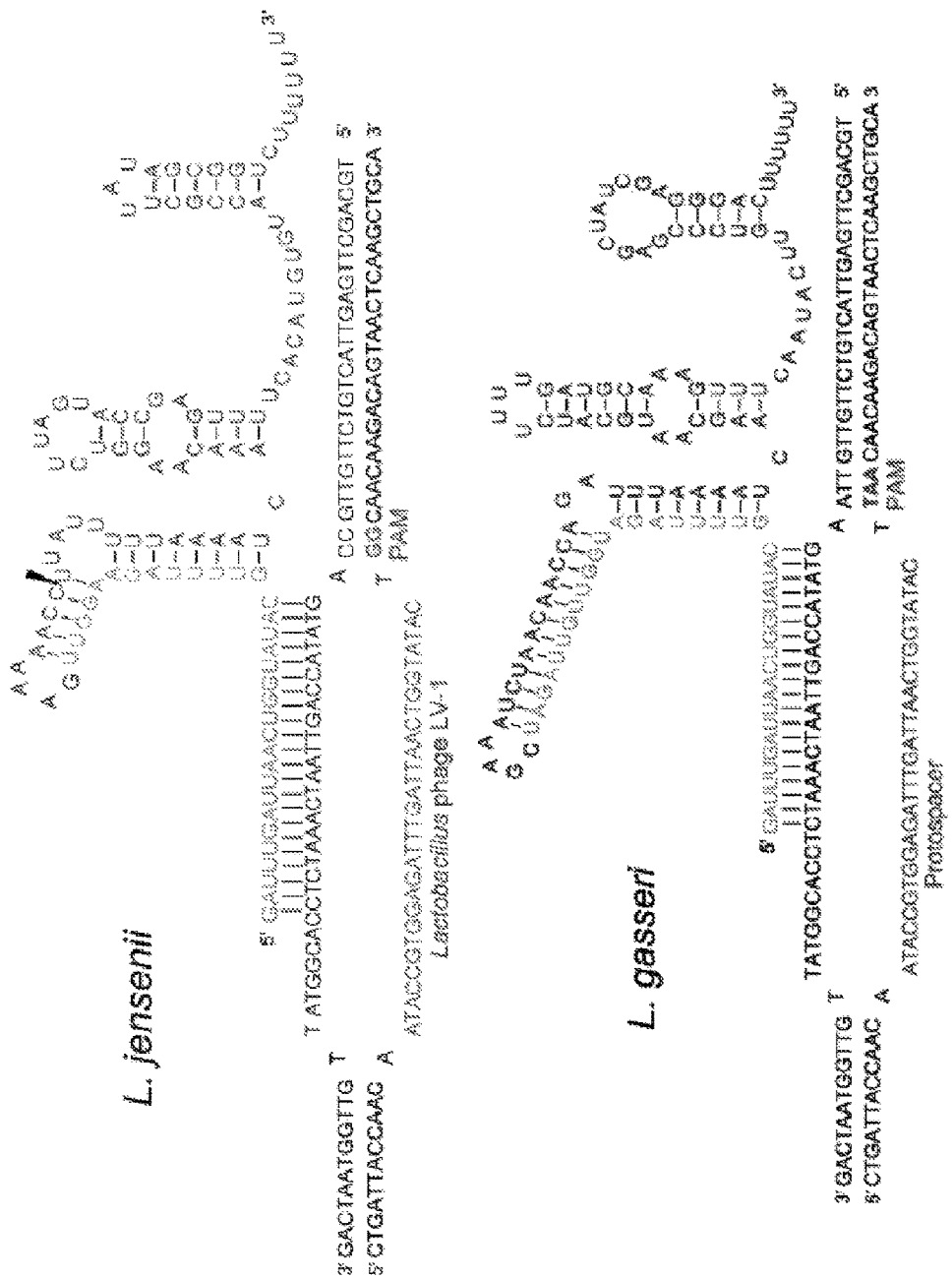
FIG. 18 shows the native tracrRNA:crRNA duplexes that have been combined into single guide RNAs for ease of visualization. The sequences were confirmed via RNA Seq and the structures were predicted using RNA folding software (Upper panel: *Lactobacillus jensenii* sgRNA: guide SEQ ID N0:395, target top SEQ ID NO:396, target bottom SEQ NO:397; Lower panel: *Lactobacillus gasseri* sgRNA: guide SEQ ID NO:398, target top SEQ ID NO:399, target bottom SEQ ID NO:400).
Figure 19:
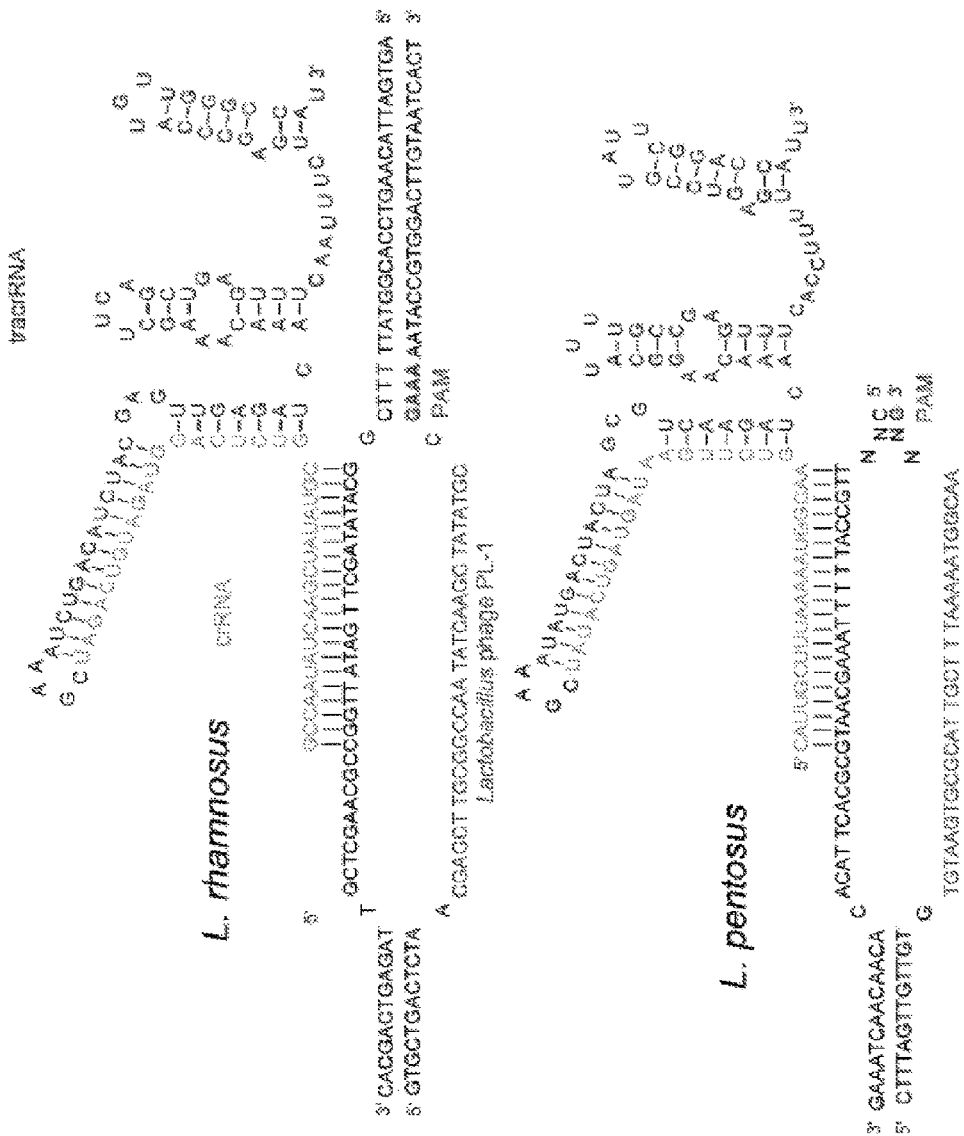
FIG. 19 shows the native tracrRNA:crRNA duplexes that have been combined into single guide RNAs for ease of visualization. The sequences were confirmed via RNA Seq and the structures were predicted using RNA folding software (Upper panel: *Lactobacillus rhamnosus* sgRNA: guide SEQ ID NO:401, target top SEQ ID NO:402, target bottom SEQ ID NO:403; Lower panel: *Lactobacillus pentosus* sgRNA: guide SEQ ID NO:404, target top SEQ ID NO:405, target bottom SEQ ID NO:406).
Figure 20:
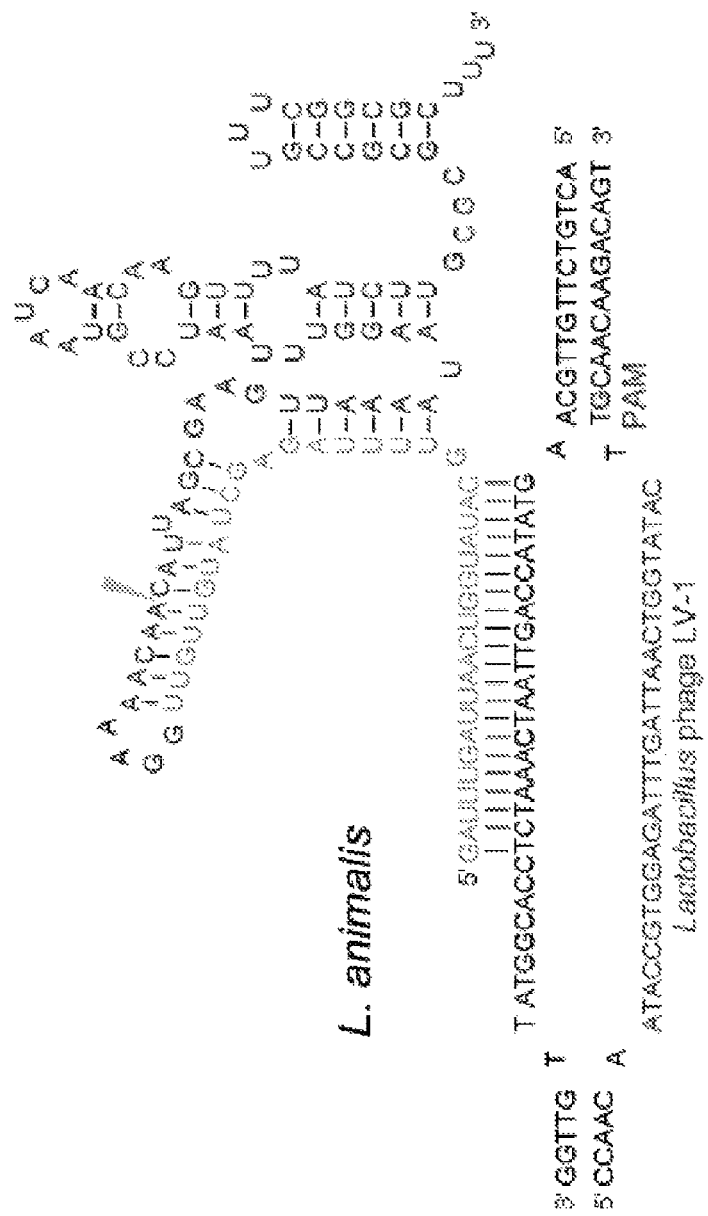
FIG. 20 shows the native tracrRNA:crRNA duplexes that have been combined into single guide RNAs for ease of visualization. The sequences were confirmed via RNA Seq and the structures were predicted using RNA folding software (*Lactobacillus animalis* sgRNA: guide SEQ ID NO:407, target top SEQ ID NO:408, target bottom SEQ ID NO:409).

FIG. 17 shows the native tracrRNA:crRNA duplexes that have been combined into single guide RNAs for ease of visualization. Based on the Cas9 proteins, Cas1 proteins, CRIPSR repeats, leader sequences, PAM motifs, guide sequences and structures, the *Lactobacillus buchneri* and *Pediococcus parvulus* CRISPR-Cas systems are likely not orthogonal. FIG. 18 shows the native tracrRNA:crRNA duplexes that have been combined into single guide RNAs for ease of visualization. Based on the Cas9 proteins, Cas1 proteins, CRIPSR repeats, leader sequences, PAM motifs, guide sequences and structures, the *Lactobacillus jensenii* and *Lactobacillus gasseri* CRISPR-Cas systems are likely not orthogonal. FIG. 19 shows the native tracrRNA:crRNA duplexes that have been combined into single guide RNAs for ease of visualization. Based on the Cas9 proteins, Cas1 proteins, CRIPSR repeats, leader sequences, PAM motifs, guide sequences and structures, the *Lactobacillus rhamnosus* and *Lactobacillus pentosus* CRISPR-Cas systems are likely not orthogonal. FIG. 20 shows the native tracrRNA:crRNA duplexes that have been combined into single guide RNAs for ease of visualization. Based on the Cas9 proteins, Cas1 proteins, CRIPSR repeats, leader sequences, PAM motifs, guide sequences and structures, the *Lactobacillus animalis* CRISPR-Cas systems is likely to be orthogonal to all other systems.

Figure 21:
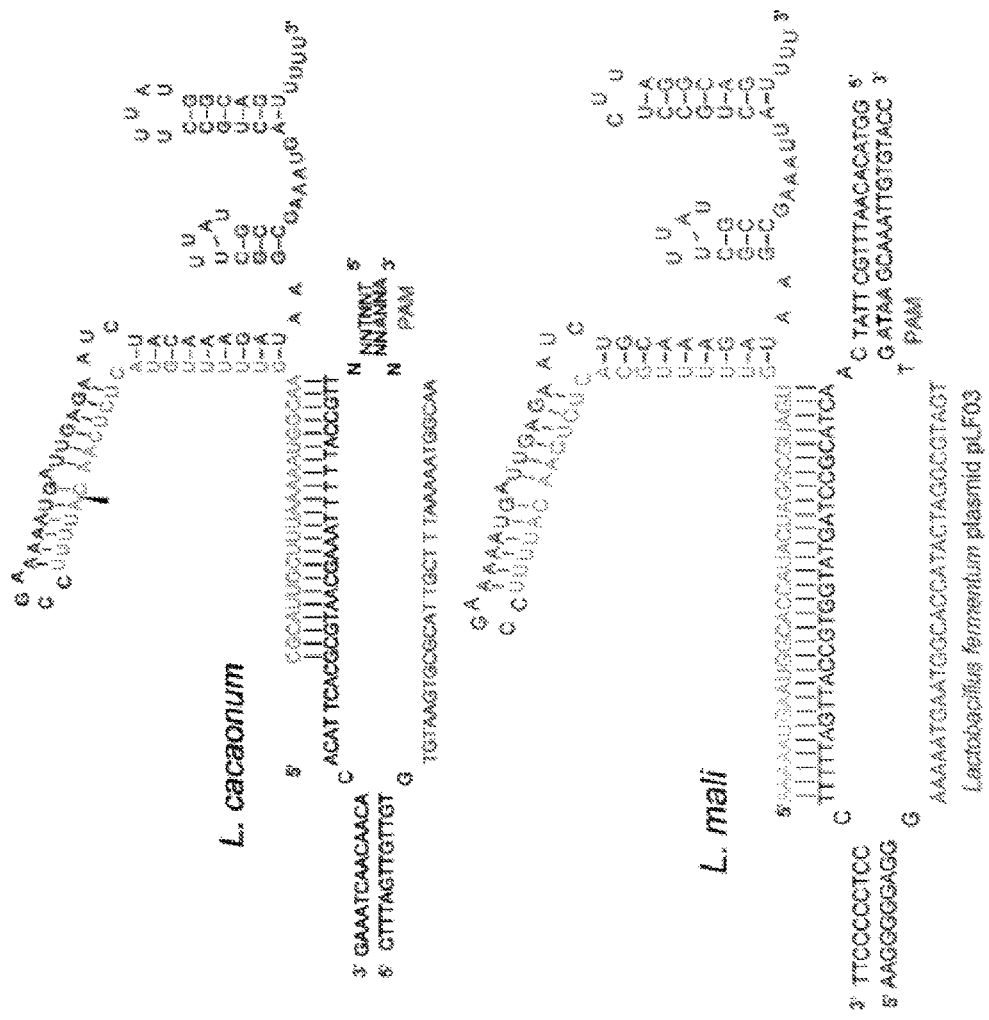
FIG. 21 shows the native tracrRNA:crRNA duplexes that have been combined into single guide RNAs for ease of visualization. The sequences were confirmed via RNA Seq and the structures were predicted using RNA folding software (Upper panel: *Lactobacillus cacaonum* sgRNA: guide SEQ ID NO:410, target top SEQ ID NO:411, target bottom SEQ ID NO:412; Lower panel: *Lactobacillus mali* sgRNA: guide SEQ ID NO:413, target top SEQ ID NO:414, target bottom SEQ ID NO:415).
Figure 22:
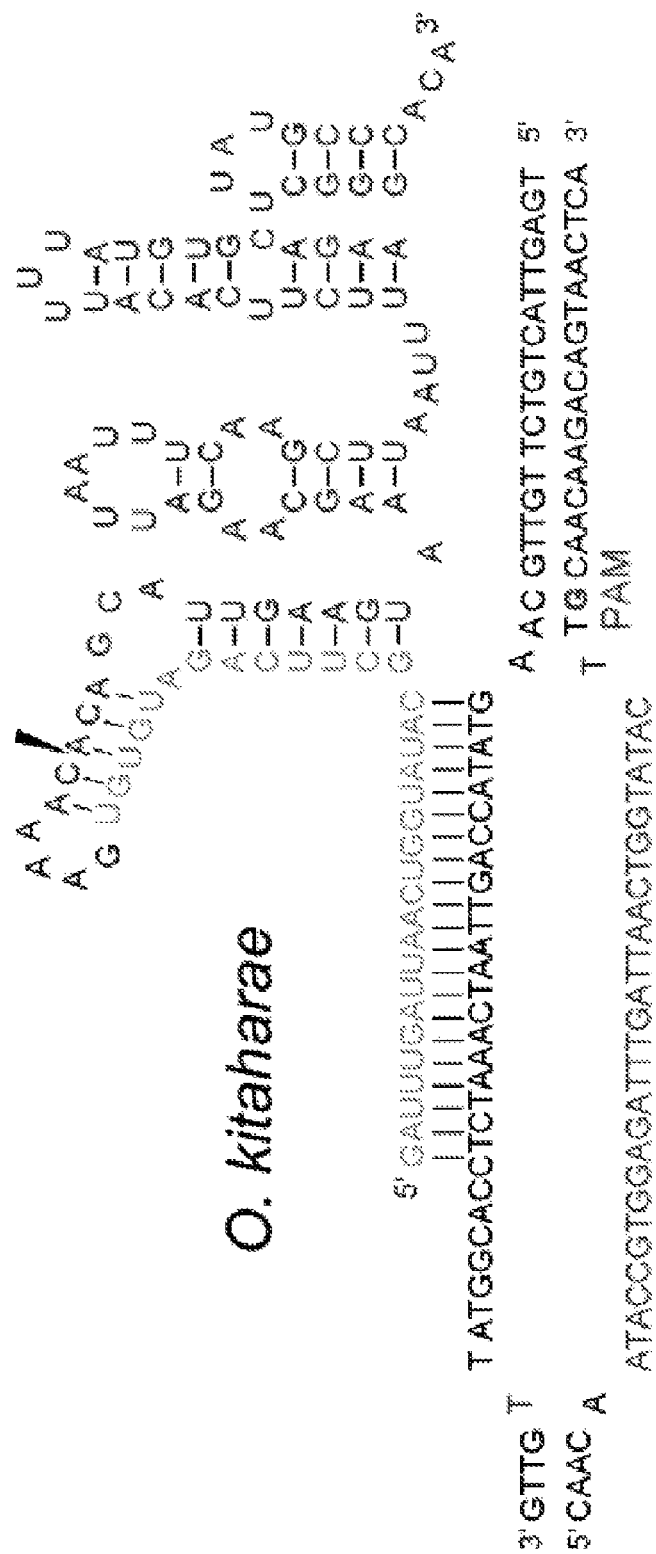
FIG. 22 shows the native tracrRNA:crRNA duplexes that have been combined into single guide RNAs for ease of visualization. The sequences were confirmed via RNA Seq and the structures were predicted using RNA folding software (*Oenococcus kitaharae* sgRNA: guide SEQ ID NO:416, target top SEQ ID NO:417, target bottom SEQ ID NO:418).

FIG. 21 shows the native tracrRNA:crRNA duplexes that have been combined into single guide RNAs for ease of visualization. Based on the Cas9 proteins, Cas1 proteins, CRIPSR repeats, leader sequences, PAM motifs, guide sequences and structures, the *Lactobacillus cacaonum* and *Lactobacillus mali* CRISPR-Cas systems are likely not orthogonal with each other. FIG. 22 shows the native tracrRNA:crRNA duplexes that have been combined into single guide RNAs for ease of visualization. Based on the Cas9 proteins, Cas1 proteins, CRIPSR repeats, leader sequences, PAM motifs, guide sequences and structures, the *Oenococcus kitaharae* CRISPR-Cas systems is likely to be orthogonal to all other systems.

Figure 23:
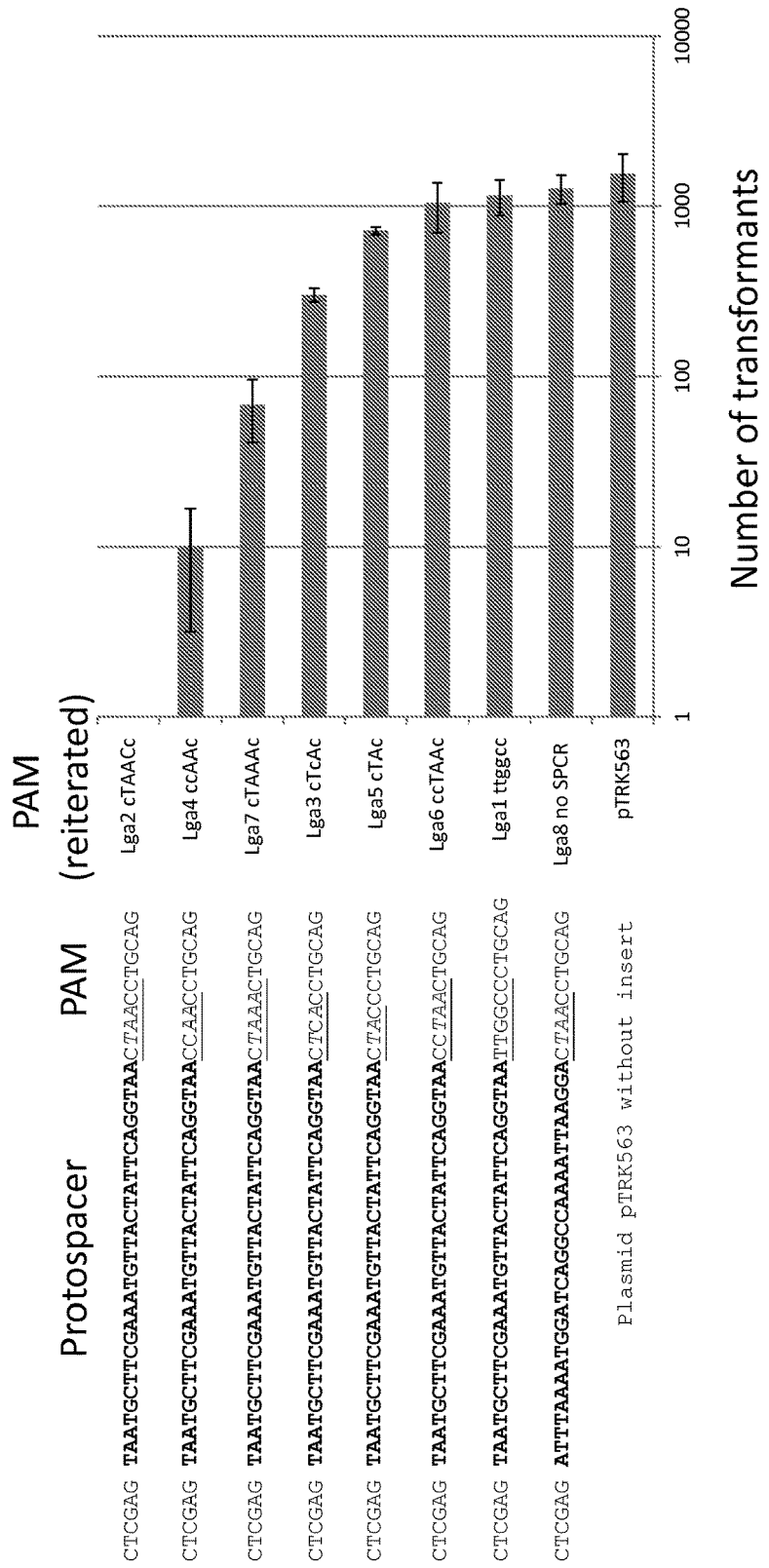
FIG. 23 shows the activity of the Type II CRISPR-Cas system in *Lactobacillus gasseri* (Lga) using a plasmid interference assay. The PAM region is underlined and again shown next to the bar chart. The italicized nucleotides in the alignment and those capitalized next to the bar chart are the nucleotides from the predicted PAM. Non-italicized underlined nucleotides and lowercase letters are mutations to the predicted PAM (SEQ ID NOs:419-426).

Using a plasmid interference assay activity of the Type II CRISPR-Cas system in *Lactobacillus gasseri* (Lga) was investigated (see, FIG. 23). Here, a highly expressed spacer sequence from the Lga CRISPR repeat spacer array was identified and used to design plasmids flanked by mutated PAMs to determine activity and flexibility of Cas9-based DNA targeting. Six different mutations of the PAM were tested. Targeting by active Type II CRISPR-Cas systems using Cas9 is shown by a decrease in transformants. If the Cas9 is able to recognize the PAM on the plasmid, the plasmid is cleaved leading to cell death. The Lga Cas9 was able to cause a 3 log reduction in transformants when the optimal PAM was used (Lga2) demonstrating this system is active.

Figure 24:
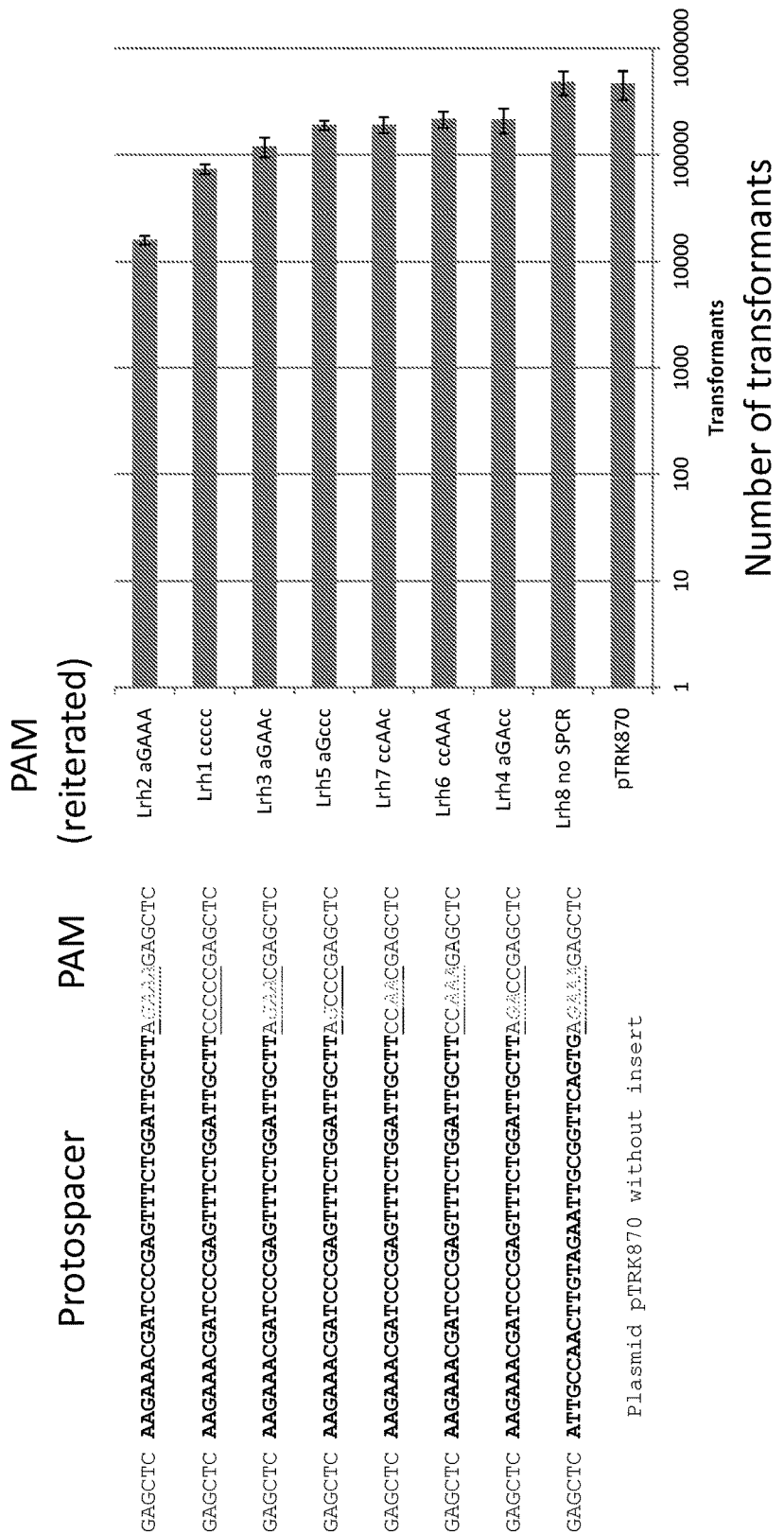
FIG. 24 shows the activity of the Type II CRISPR-Cas system in *Lactobacillus rhamnosus* (Lrh) using a plasmid interference assay. The PAM region is underlined and again shown next to the bar chart. The italicized nucleotides in the alignment and those capitalized next to the bar chart are the nucleotides from the predicted PAM. Non-italicized underlined nucleotides and lowercase letters are mutations to the predicted PAM (SEQ ID NOs:427-434).

Using a plasmid interference assay activity of the Type II CRISPR-Cas system in *Lactobacillus rhamnosus* (Lrh) was also investigated (see, FIG. 24). A highly expressed spacer sequence from the Lrh CRISPR repeat spacer array was identified and used to design plasmids flanked by mutated PAMs to determine activity and flexibility of Cas9-based DNA targeting. Six different mutations of the PAM were tested. Targeting by active Type II CRISPR-Cas systems using Cas9 is shown by a decrease in transformants. If the Cas9 is able to recognize the PAM on the plasmid, the plasmid is cleaved leading to cell death. The Lrh Cas9 was able to cause a 1.5 log reduction in transformants when the optimal PAM was used (Lrh2) demonstrating this system is active.

Figure 25:
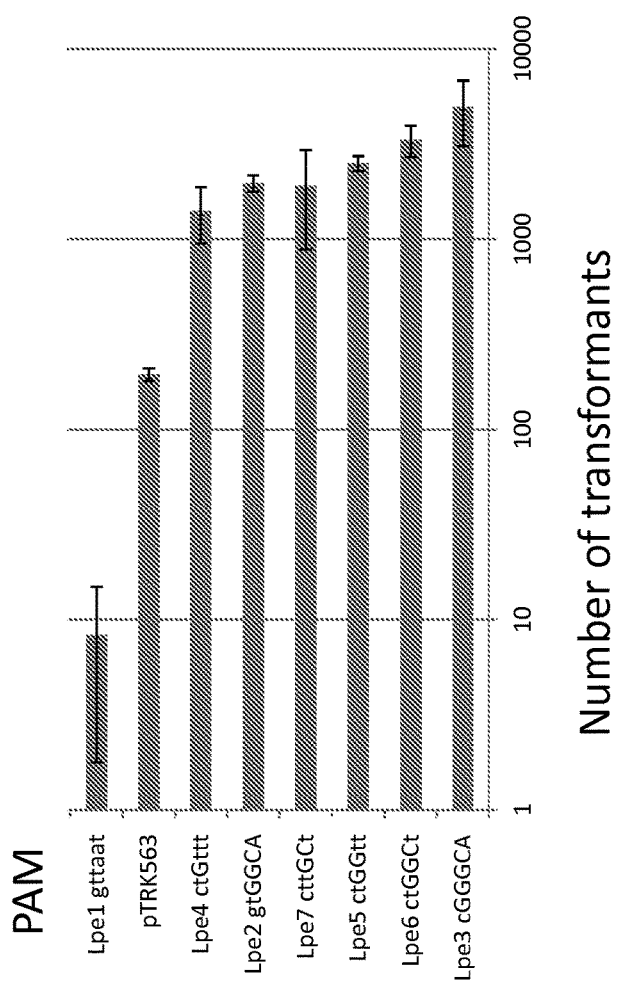
FIG. 25 shows the activity of the Type II CRISPR-Cas system in *Lactobacillus pentosus* (Lpe) using a plasmid interference assay. The PAM region is shown next to the bar chart. The capitalized nucleotides are those from the predicted PAM. Lowercase letters are mutations to the predicted PAM.

Using a plasmid interference assay activity of the Type II CRISPR-Cas system in *Lactobacillus pentosus* (Lpe) (see, FIG. 25) was invenstigated. A highly expressed spacer sequence from the Lpe CRISPR repeat spacer array was identified and used to design plasmids flanked by mutated PAMs to determine activity and flexibility of Cas9-based DNA targeting. Six different mutations of the PAM were tested. Targeting by active Type II CRISPR-Cas systems using Cas9 is shown by a decrease in transformants. If the Cas9 is able to recognize the PAM on the plasmid, the plasmid is cleaved leading to cell death. The Lpe Cas9 was able to cause a 2 log reduction in transformants when the optimal PAM was used (Lpe1) demonstrating this system is active.

Figure 26:
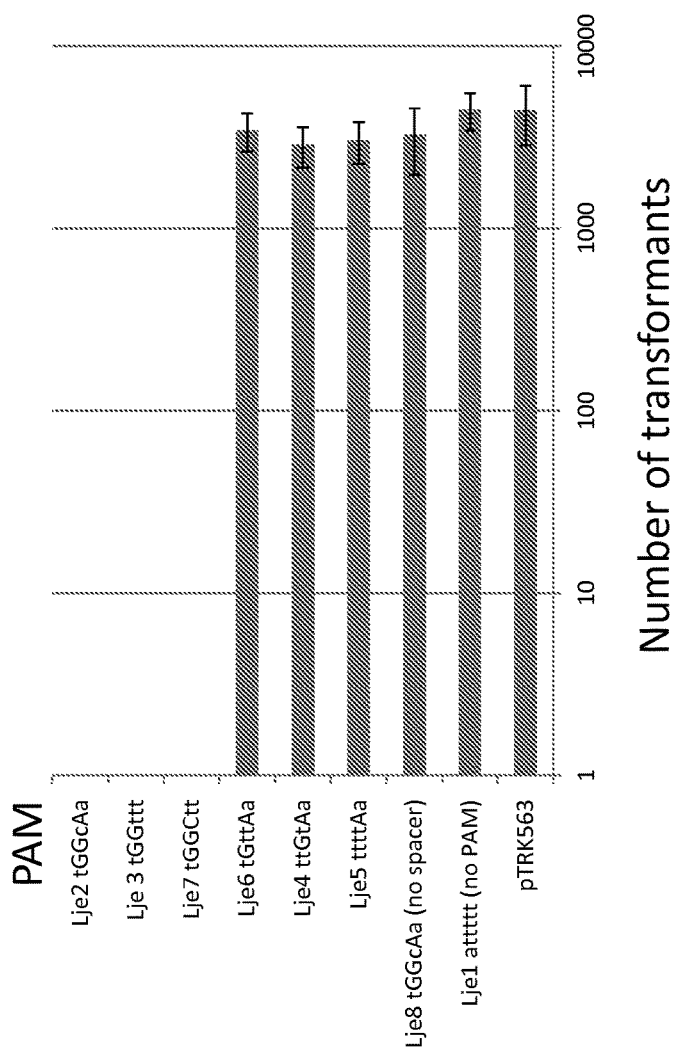
FIG. 26 shows the activity of the Type II CRISPR-Cas system in *Lactobacillus jensenii* (Lje) using a plasmid interference assay. The PAM region is shown next to the bar chart. The capitalized nucleotides are those from the predicted PAM. Lowercase letters are mutations to the predicted PAM.

In addition, a plasmid interference assay was used to show the activity of the Type II CRISPR-Cas system in *Lactobacillus jensenii* (Lje) (see, FIG. 26). A highly expressed spacer sequence from the Lje CRISPR repeat spacer array was identified and used to design plasmids flanked by mutated PAMs to determine activity and flexibility of Cas9-based DNA targeting. Six different mutations of the PAM were tested. Targeting by active Type II CRISPR-Cas systems using Cas9 is shown by a decrease in transformants. If the Cas9 is able to recognize the PAM on the plasmid, the plasmid is cleaved leading to cell death. The Lje Cas9 was able to cause a 3 log reduction in transformants when the optimal PAM was used (Lje2, Lje3, Lje7) demonstrating this system is active.

Figure 27:
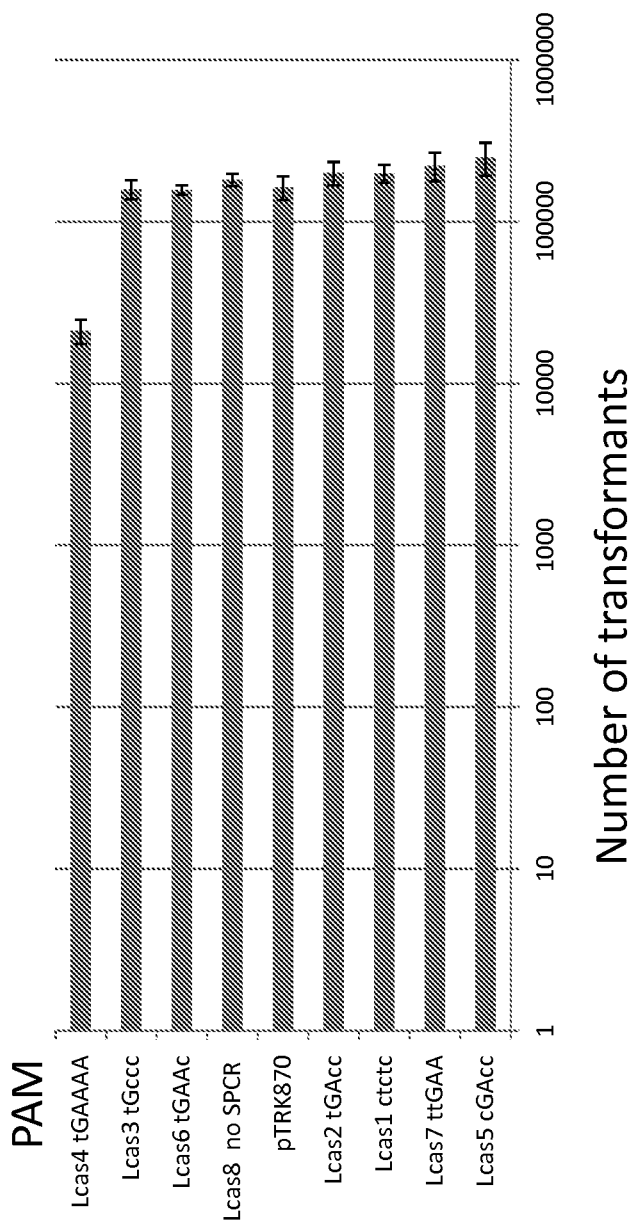
FIG. 27 shows the activity of the Type II CRISPR-Cas system in *Lactobacillus casei* (Lcas) using a plasmid interference assay. The PAM region is shown next to the bar chart. The capitalized nucleotides are those from the predicted PAM. Lowercase letters are mutations to the predicted PAM.

The activity of the Type II CRISPR-Cas system in *Lactobacillus casei* (Lcas) was investigated using a plasmid interference assay (see, FIG. 27). A highly expressed spacer sequence from the Lcas CRISPR repeat spacer array was identified and used to design plasmids flanked by mutated PAMs to determine activity and flexibility of Cas9-based DNA targeting. Six different mutations of the PAM were tested. Targeting by active Type II CRISPR-Cas systems using Cas9 is shown by a decrease in transformants. If the Cas9 is able to recognize the PAM on the plasmid, the plasmid is cleaved leading to cell death. The Lcas Cas9 was able to cause a 1 log reduction in transformants when the optimal PAM was used (Lcas4) demonstrating this system is active.

Figure 28:
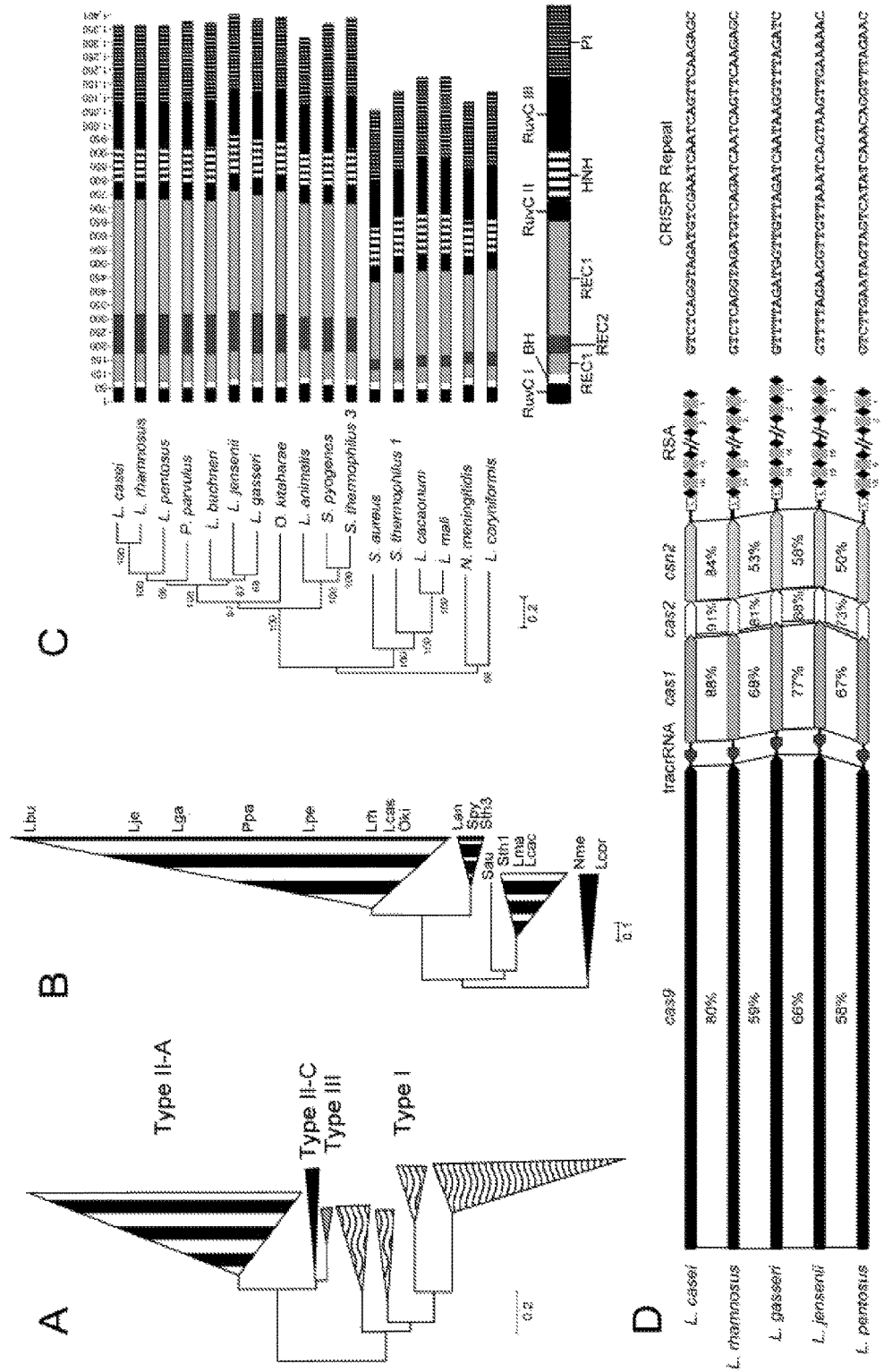
FIG. 28. Panel A is a Neighbor-joining tree from a MUSCLE alignment of the Cas1 proteins from 137 *lactobacilli* and closely-related organisms; the tree is rooted on the Type I/Type II branch. The branches have been condensed for clarity. The Type I systems are filled with wavy lines, Type III in grey, Type II-C in black, and Type II-A in stripes. Panel B is a Neighbor-joining tree from a MUSCLE alignment of Cas9 proteins in 68 organisms; the tree is rooted in the Type II-C branch. The three letter identifying code corresponds to Lbu (*Lacotbacillus buchneri*), PpaB (*Pediococcus parvulus*), Lga (*Lactobacillus gasseri*), Lje (*Lactobacillus jensenii*), Lpe (*Lactobacillus pentosus*), Lcas (*Lactobacillus casei*), Lrh (*Lactobacillus rhamnosus*), Oki (*Oenococcus kitaharae*), Lan (*Lactobacillus animalis*), Lcaca (*Lactobacillus cacaonum*), Lma (*Lactobacillus mali*), Spy (*Streptococcus pyogenes*), Sth3 (*Streptococcus thermophilus* CRISPR 3), Sau (*Staphylococcus aureus*), Sth1 (*Streptococcus thermophilus* CRISPR 1), and Nme (*Neisseria meningitidis*). The Cas9 proteins grouped into 5 groups that were condensed by branches. The striped branches are Type II-A Cas9s that group by length and sequence. The black branch is the II-C Cas9s. Panel C is a linear representation of the Cas9 domains determined by Nishimasu et al. (*Cell* 156(5):935-49 (2014)) from the Spy Cas9. Inter Scan Pro and Pfam databases were used to predict protein motifs. A MUSCLE alignment was used to map the homologous domains onto all Cas9 sequences. An annotated demonstration of the Cas9 domains is shown at the bottom. There are three RuvC domains (labeled I through III and colored black), a single bridge helix domain (BH) colored white, two recognition domains (REC1 and REC2) colored light and dark grey, an HNH nicking domain in wide stripes, and the PAM interacting domain (PI) in narrow stripes. Panel D is a layout of five select CRISPR-Cas loci. The protein similarity, shown as a percentage between the loci, compares the two proteins directly above and below the number. Cas9 is black, the tracrRNA is dark grey, Cas1 is medium grey, Cas2 is white, Csn2 is light grey, the leader sequence is a white box with an L, CRISPR repeats are represented as black diamonds, and CRISPR spacers are light grey diamonds. The repeat-spacer arrays have been abbreviated; the number underneath the spacers depicts the order it was acquired in the array. The CRISPR repeat sequence is also shown at the right (The repeat sequences from top to bottom, SEQ ID NO:435, SEQ ID NO:436, SEQ ID NO:437, SEQ ID NO:438, and SEQ ID NO:439, respectively).

Finally, Neighbor-joining trees from MUSCLE alignments of the Cas1 protein and of Cas9 protein are provided in Panel A and Panel B of FIG. 28. Please provide any discussion of FIG. 28, Panels A and B that is needed.

FIG. 28, Panel C is a linear representation of the Cas9 domains as provided by Nishimasu et al. (*Cell* 156(5):935-49 (2014)) for Spy Cas9. Panel D is a layout of five select CRISPR-Cas loci.

The above examples clearly illustrate the advantages of the invention. Although the present invention has been described with reference to specific details of certain embodiments thereof, it is not intended that such details should be regarded as limitations upon the scope of the invention except as and to the extent that they are included in the accompanying claims.

SEQUENCE LISTING (439 sequences)

SEQ ID NO: 1 - DNA, 37 bp, Bifidobacterium bombi
ccagtatatcagaggggctttagattgaatttgaaac

SEQ ID NO: 2 - DNA, 36 bp, Bifidobacterium dentium LMG 11045
caagtttatcaagaagggtagaagctaattcccagt

SEQ ID NO: 3 - DNA, 36 bp, Bifidobacterium merycicum LMG 11341
gtttcagatgcctgtcagatcaaggacctagaccac

SEQ ID NO: 4 - DNA, 36 bp, Kandleria vitulina DSM 20405
gttttagagttgtgttattttgaacagatacaaaac

SEQ ID NO: 5 - DNA, 36 bp, Lactobacillus agilis DSM 20509
gtctcagaagtatgttaaatcaatgatgtttagtac

SEQ ID NO: 6 - DNA, 36 bp, Lactobacillus animalis DSM 20602
gttttagagctatgttgttttgtatgactccaaaac

SEQ ID NO: 7 - DNA, 36 bp, Lactobacillus apodemi DSM 16634
gttttagagctatgtagttttgtatgactccaaaac

SEQ ID NO: 8 - DNA, 36 bp, Lactobacillus brevis subsp gravensis ATCC 27305
gctttagtaggatgttaaatcaatgatgttaaaccc

SEQ ID NO: 9 - DNA, 36 bp, Lactobacillus buchneri DSM 20057
gctttagtagtagttcaaaacaatgatgttttatcc

SEQ ID NO: 10 - DNA, 36 bp, Lactobacillus buchneri CD034
gttttagaaggatgttaaatcaataaggttaaaccc

SEQ ID NO: 11 - DNA, 36 bp, Lactobacillus cacaonum DSM 21116
gtttttgtactctcaacattttcctatcagtaaaac

SEQ ID NO: 12 - DNA, 36 bp, Lactobacillus casei str Zhang
gtctcaggtagatgtcgaatcaatcagttcaagagc

SEQ ID NO: 13 - DNA, 36 bp, Lactobacillus ceti DSM 22408
gtttgagaagtgtgttgttctcgataggtcttaaac

SEQ ID NO: 14 - DNA, 36 bp, Lactobacillus coryniformis subsp coryniformis KCTC 3167
gttttagaagagtgttaaatcaatgagtttagaacc

SEQ ID NO: 15 - DNA, 36 bp, Lactobacillus coryniformis torquens
gctattgattccttcagttttcagctaaaatagatc

SEQ ID NO: 16 - DNA, 36 bp, Lactobacillus crispatus FB049-03
gttttagatgattgttagatcaatgaggtttagatc

SEQ ID NO: 17 - DNA, 36 bp, Lactobacillus curvatus CRL 705
gttttagaagagtatcaaatcaatgagtagttcaac

SEQ ID NO: 18 - DNA, 36 bp, Lactobacillus delbrueckii subsp lactis CRL 581
gttttagaaggttgtctattcaataaggtttaaccc

SEQ ID NO: 19 - DNA, 36 bp, Lactobacillus delbrueckii jakobsenii DSM 26046
gggttaaaccttattgaatagacaaccttctaaaac

SEQ ID NO: 20 - DNA, 36 bp, Lactobacillus diolivorans DSM 14421
gttttagaagactgttgaatcaatgatgtttagtcc

SEQ ID NO: 21 - DNA, 36 bp, Lactobacillus farciminis DSM 20184
gttttagaagtatgtctttctatttacttaagaacc

SEQ ID NO: 22 - DNA, 36 bp, Lactobacillus fermentum DSM 20055
gtcttggatgagtgtcagatcagtagttccgagtac

SEQ ID NO: 23 - DNA, 36 bp, Lactobacillus floricola DSM 23037 A
gtttcagaagtatgtcatttgaataatgttaggact

SEQ ID NO: 24 - DNA, 36 bp, Lactobacillus floricola DSM 23037 B
gttttagaagtatgtcaaatcaataaggttaatacc

SEQ ID NO: 25 - DNA, 36 bp, Lactobacillus fuchuensis DSM 14340
gttttagaagagtatcaaatcaatgagttcatcaac

SEQ ID NO: 26 - DNA, 36 bp, Lactobacillus futsaii JCM 17355
gtttttgtaccttaaagaatctagaaatagtaaaac

SEQ ID NO: 27 - DNA, 36 bp, Lactobacillus gasseri K7
gttttagatggttgttagatcaataaggcttagatc

SEQ ID NO: 28 - DNA, 36 bp, Lactobacillus graminis DSM 20719; identical to SEQ ID NO: 17

SEQ ID NO: 29 - DNA, 36 bp, Lactobacillus hammesii DSM 16381
gctttagattagtgacaattcagtaaggtcaagagc

SEQ ID NO: 30 - DNA, 36 bp, Lactobacillus hominis CRBIP
gttttagttagttgttagatcaataaggtttagatc

SEQ ID NO: 31 - DNA, 35 bp, Lactobacillus hordei DSM 19519 A
gttttagaaagacgttaaaccaataatgttagatc

SEQ ID NO: 32 - DNA, 36 bp, Lactobacillus hordei DSM 19519 B; identical to SEQ ID NO: 11

SEQ ID NO: 33 - DNA, 36 bp, Lactobacillus jensenii DSM 20557
gttttagaaggttgttaaatcagtaagttgaaaaac

SEQ ID NO: 34 - DNA, 36 bp, Lactobacillus johnsonii DPC 6026
gttttagatggttgttagatcaataaggtttagatc

SEQ ID NO: 35 - DNA, 36 bp, Lactobacillus lindneri DSM 20690
gttcttaatctcattagaatgacgtacttctaaaac

SEQ ID NO: 36 - DNA, 36 bp, Lactobacillus mali ATCC 27304
gtttttgcactctcaacattttcctatcaataaaac

SEQ ID NO: 37 - DNA, 35 bp, Lactobacillus mindensis DSM 14500
gttttagaagtaagtcatctcaattactaagaacc

SEQ ID NO: 38 - DNA, 36 bp, Lactobacillus mucosae DSM 13345
gctttagatggatgttaaatcaatgatgtaattctc

SEQ ID NO: 39 - DNA, 36 bp, Lactobacillus namurensis DSM 19117
gtttcaaatgagtggtaaatctataaggtcaatacc

SEQ ID NO: 40 - DNA, 36 bp, Lactobacillus nantensis DSM 16982
gtttttgtaccttcaaagatttagaaacagtaaaac

SEQ ID NO: 41 - DNA, 36 bp, Lactobacillus nodensis DSM 19682 A
gttttagtactctcaagaatttagtaacagtaaaac

SEQ ID NO: 42 - DNA, 36 bp, Lactobacillus nodensis DSM 19682 B
gttttagaagtacgtcatttcatgtagttaagaacc

SEQ ID NO: 43 - DNA, 36 bp, Lactobacillus oligofermentans DSM 15707
gttttagaagagtatcaaatcaatgagttcgagacc

SEQ ID NO: 44 - DNA, 36 bp, Lactobacillus otakiensis DSM 19908; identical to SEQ ID NO: 10

SEQ ID NO: 45 - DNA, 36 bp, Lactobacillus ozensis DSM 23829
gttattaatacattacaaatacatagatgttataat

SEQ ID NO: 46 - DNA, 36 bp, Lactobacillus paracasei subsp paracasei 8700:2; identical to SEQ ID NO: 12

SEQ ID NO: 47 - DNA, 36 bp, Lactobacillus paracasei subsp tolerans Lpl7; identical to SEQ ID NO: 12

SEQ ID NO: 48 - DNA, 36 bp, Lactobacillus paracollinoides DSM 15502
gttttagatgaatatcaaatcaatgaggttcaaagc

SEQ ID NO: 49 - DNA, 36 bp, Lactobacillus parakefiri DSM 10551; identical to SEQ ID NO: 10

SEQ ID NO: 50 - DNA, 36 bp, Lactobacillus pentosus IG1
gtttcagaaggacattaaatcaataaggtcaagacc

SEQ ID NO: 51 - DNA, 36 bp, Lactobacillus pentosus KCA1
gtcttgaatagtagtcatatcaaacaggtttagaac

SEQ ID NO: 52 - DNA, 36 bp, Lactobacillus plantarum EGD-AQ4; identical to SEQ ID NO: 51

SEQ ID NO: 53 - DNA, 36 bp, Lactobacillus psittaci DSM 15354; identical to SEQ ID NO: 33

SEQ ID NO: 54 - DNA, 36 bp, Lactobacillus rennini DSM 20253
gttttagaagagtatcaaatcaatgagtttatcaac

SEQ ID NO: 55 - DNA, 36 bp, Lactobacillus reuteri mlc3
gttttagatgtacttcaaatcaataatgtttagaac

SEQ ID NO: 56 - DNA, 36 bp, Lactobacillus rhamnosus GG
gtctcaggtagatgtcagatcaatcagttcaagagc

SEQ ID NO: 57 - DNA, 36 bp, Lactobacillus rossiae DSM 15914
gttttagatgtatgtcagatcaatagggttaagaac

SEQ ID NO: 58 - DNA, 36 bp, Lactobacillus ruminis ATCC 25644
gtttcagctggatgtcatatcaatgatgttatgaac

SEQ ID NO: 59 - DNA, 36 bp, Lactobacillus sakei carnosus DSM 15831; identical to SEQ ID NO: 17

SEQ ID NO: 60 - DNA, 36 bp, Lactobacillus salivarius UCC 118
gtttcagaagtatgttaaatcaataaggttaagacc

SEQ ID NO: 61 - DNA, 36 bp, Lactobacillus sanfranciscensis DSM 20451
gttttagaagtacgtcattctaatgagattaagagc

SEQ ID NO: 62 - DNA, 36 bp, Lactobacillus saniviri DSM 24301
gttttagttggatgtcagatcaaataggttaagcac

SEQ ID NO: 63 - DNA, 36 bp, Lactobacillus senmaizukei DSM 21775
gttttagttcagtgacaaatcaatagagttaagaac

SEQ ID NO: 64 - DNA, 36 bp, Lactobacillus tucceti DSM 20183
gtttttgtactcttaaggatttagtaatagtaaaac

SEQ ID NO: 65 - DNA, 36 bp, Lactobacillus versmoldensis DSM 14857
gttttagatctaagtcatctcaattacttaagaacc

SEQ ID NO: 66 - DNA, 36 bp, Lactobacillus zymae DSM 19395
gttttagatgagtggtaaatctagaaggtcaaaagc

SEQ ID NO: 67 - DNA, 36 bp, Leuconostoc gelidum JB7
gcttcagatgtgtgtcagatcaatgaggtttaaacc

SEQ ID NO: 68 - DNA, 36 bp, Leuconostoc pseudomesenteroides 4882
gtataaagccccattgatctgacatacatctgaagc

SEQ ID NO: 69 - DNA, 36 bp, Oenococcus kitaharae DSM 17330
gcttcagatgtgtgtcagatcaatgaggtagaaccc

SEQ ID NO: 70 - DNA, 36 bp, Pediococcus inopinatus DSM 20285
gttttagaagagtgtcgaatcaatatagttaagatc

SEQ ID NO: 71 - DNA, 36 bp, Pediococcus lolii DSM 19927
gtttcagaaggatgttaaatcaataaggttaagatc

SEQ ID NO: 72 - DNA, 36 bp, Pediococcus parvulus DSM 20332 A; identical to SEQ ID NO: 71

SEQ ID NO: 73 - DNA, 36 bp, Pediococcus parvulus DSM 20332B
gttttagaagagtgtcgaatcaatatagttaagagc

SEQ ID NO: 74 - DNA, 36 bp, Pediococcus stilesii DSM 18001
gtttcagagggatgttaaagaagtaggttcaatatc

SEQ ID NO: 75 - DNA, 36 bp, Steptococcus agalactiae GB00300
gttttagagctgtgctgtttcgaatggttccaaaac

SEQ ID NO: 76 - DNA, 36 bp, Steptococcus gallolyticus ATCC BAA-2069; identical to SEQ ID NO: 75

SEQ ID NO: 77 - DNA, 36 bp, Steptococcus henryi DSM 19005
gtttttgtactctcaagatttaagtaactgtaaaac

SEQ ID NO: 78 - DNA, 36 bp, Steptococcus mutans NLML5
gtttttgtactctcaagatttaagtaactgtacaac

SEQ ID NO: 79 - DNA, 36 bp, Steptococcus oralis SK304
gttttagagctgtgttgtttcgaatggttccaaaac

SEQ ID NO: 80 - DNA, 36 bp, Streptococcus anginosus 1_2_62CV; identical to SEQ ID NO: 77

SEQ ID NO: 81 - DNA, 36 bp, Streptococcus anginosus DSM 20563; identical to SEQ ID NO: 75

SEQ ID NO: 82 - DNA, 36 bp, Streptococcus dysagalactiae subsp equisimilis
gttttagagctatgttgttttgaatggtcccaaaac

SEQ ID NO: 83 - DNA, 36 bp, Streptococcus equi subsp zooepidemicus
gttttagagttatgctgtattgaatggttccaaaac

SEQ ID NO: 84 - DNA, 36 bp, Streptococcus gordonii Challis substr CH1; identical to SEQ ID NO: 78

SEQ ID NO: 85 - DNA, 36 bp, Streptococcus infantarius subsp infantarius
gtttttgtactctcaagatttaagtaaccgtaaaac

SEQ ID NO: 86 - DNA, 36 bp, Streptococcus intermedius B196
gtttttgtactctcaagatttaagtaactgcaaaac

SEQ ID NO: 87 - DNA, 36 bp, Streptococcus lutetiensis 033; identical to SEQ ID NO: 79

SEQ ID NO: 88 - DNA, 36 bp, Streptococcus mitis SK321; identical to SEQ ID NO: 79

SEQ ID NO: 89 - DNA, 36 bp, Streptococcus mutans TA 159; identical to SEQ ID NO: 79

SEQ ID NO: 90 - DNA, 36 bp, Streptococcus orisratti DSM 15617; identical to SEQ ID NO: 77

SEQ ID NO: 91 - DNA, 36 bp, Streptococcus parasanguinis F0449; identical to SEQ ID NO: 86

SEQ ID NO: 92 - DNA, 36 bp, Streptococcus salivarius K12; identical to SEQ ID NO: 79

SEQ ID NO: 93 - DNA, 36 bp, Streptococcus sanguinis SK330; identical to SEQ ID NO: 79

SEQ ID NO: 94 - DNA, 36 bp, Streptococcus vestibularis ATCC 49124; identical to SEQ ID NO: 78

SEQ ID NO: 95 - DNA, 36 bp, Lactobacillus composti DSM 18527
gttctggaagtatgtcagatcaatggattcaagagc

SEQ ID NO: 96 - DNA, 36 bp, Lactobacillus concavus DSM 17758
gttttagaagagtgtcatttcaataaggttaagatc

SEQ ID NO: 97 - DNA, 36 bp, Weissella halotolerans DSM 20190
gctttagatgtatgtcagattaatggggtttattcc

SEQ ID NO: 98 - DNA, 36 bp, Weissella kandleri DSM 20593
gcttcatatctctgtcaaattaatgagttgtttagc

SEQ ID NO: 99 - DNA, 136 bp, Bifidobacterium dentium LMG 11045
tggctttatcaagaatggtgagaccagtccgatggtggatgaggatctgctctttttcattacgaaatccataaaaaggaatgacatcatgcaattcaacatatccatagctgtattgcatgatgtcattcctttt

SEQ ID NO: 100 - DNA, 129 bp, Bifidobacterium merycicum LMG 11341
ggtgtctaggtccttgacctgataggcatatattgaaataaagcaagacccttgggtcaagcttcagaaggttttagacctggccttatggccatggggctcccggcagcgccgggagcccctctttct

SEQ ID NO: 101 - DNA, 109 bp, Kandleria vitulina DSM 20405
agttttggtctgttcaaaataacacaacgagttaaaataaagcttatgcttaaatgctggttatccagttgtcatttagatgacgtgcatcacttcggtgatgcttttt

SEQ ID NO: 102 - DNA, 126 bp, Lactobacillus agilis DSM 20509
catctaaacattattgatttaacatactgtgttgagatcaaacggagctttttagcgatgtttatccttttgagccattatatggccatacatattataaaaagtgcccctaaaagggcacttttt

SEQ ID NO: 103 - DNA, 104 bp, Lactobacillus animalis DSM 20602
ctagtggagttatacaaaacaacattagcgaagttaaaataaggtttaatccgtaatcaacaagttttatcttgcgcgcgccgtttcggcgctttttttgtttt

SEQ ID NO: 104 - DNA, 88 bp, Lactobacillus apodemi DSM 16634
tacgtggagtcatacaaagccacatagcaagttaaaataaggttttatccgtaatcaatcatgggcgctgtttcggcgcctatttttt

SEQ ID NO: 105 - DNA, 103 bp, Lactobacillus brevis subsp gravensis ATCC 27305
cctgtttaacatcattgatttaacatcctggtttaaagtcaaacaaggcagtaatgccaagttcttacttatgactcacgtatgtgagcatacatataaaaaa

SEQ ID NO: 106 - DNA, 102 bp, Lactobacillus buchneri DSM 20057
cggatagacatcattgttttgaactactggtttaaagtcaaacaaggtagcaataccaagttcttacttatgacccatttatatgggcatacatacaataaa

SEQ ID NO: 107 - DNA, 139 bp, Lactobacillus buchneri CD034
atgtttgaccttattgatttaacatcctgtgttaaaatcaagcaaagcgctttgcgcggagtttcaacttttgacccattatatgggcattacataagcgaaaggaaccattcttcagttggagaatggttcctttttt

SEQ ID NO: 108 - DNA, 81 bp, Lactobacillus cacaonum DSM 21116
gttttattgataggaaaatgattgagaatctacaaagataaggctttatgccgaaatgactgcctttatggcagttttttt

SEQ ID NO: 109 - DNA, 109 bp, Lactobacillus casei str Zhang
cgttttgaactgattgattcgacatctacacgttgagatcaaacaaagcctcggctgagtttcaatttctgagcccatgttgggccatacataccgccatccgggaaaa

SEQ ID NO: 110 - DNA, 102 bp, Lactobacillus ceti DSM 22408
gttttaagacctatcgagaacaacacacttaagttcaaataaaaatttattctattgaccagaaatggcagcccgctgtgggcattttaacttcattttttt

SEQ ID NO: 111 - DNA, 113 bp, Lactobacillus coryniformis subsp coryniformis KCTC 3167
ctatctaaacttattgatttaacactctgagttaaaatcaaacaaggcgtaagccaagtttcatcttgtgagtccctatggaccataaaggcgctattgatcttcgtgatcaa

SEQ ID NO: 112 - DNA, 112 bp, Lactobacillus crispatus FB049-03
actcttaaccttattgatctaacaatcataatttaaaatcaagcaatgcgttttagtacgcagagtttcaacacttgtcccgagctatcgagggactttttttatgtaaaaa

SEQ ID NO: 113 - DNA, 113 bp, Lactobacillus curvatus CRL 705
atcgaaatactcattgatttgatactctgagttaaaatcaaacaaggtcttcggaccaagttttctattctaagcctcttatgaggcctttttttatgccttcaaaccaaaaa

SEQ ID NO: 114 - DNA, 109 bp, Lactobacillus delbrueckii subsp lactis CRL 581
acgtttgaccttattgaatagacaacctgatttaaaatcaagcaaagctcttcggagcggagtttatacatttgtcccgtgtattgcgggctttttttatgcaacaaaa

SEQ ID NO: 115 - DNA, 97 bp, Lactobacillus delbrueckii jakobsenii DSM 26046
acgttagaccttattgaatagacaacctgatttaaaatcaagcaaagctcttcggagtggagtttatacatttgtcccgcgtattgcgggctttttt

SEQ ID NO: 116 - DNA, 97 bp, Lactobacillus diolivorans DSM 14421
tgggatgtcattgtctgaatcaatgattgaaaaatataacgctcaccgtgatcacttgaagctactcaaacagctcgaggataagattgacgatccg

SEQ ID NO: 117 - DNA, 102 bp, Lactobacillus farciminis DSM 20184
ggttcgtaagtaaatagaaagacatacttagattaaaataaacaataatgttaaatggtcgtaaggctgctcccgcgtgggggctttttttttgcctttttt

SEQ ID NO: 118 - DNA, 106 bp, Lactobacillus fermentum DSM 20055
acattcgagactactgatctaacactcatagtcaagatcaaacgagtggttttccacgagttattacttttgagccatgttattctggccatacatataataaaaa

SEQ ID NO: 119 - DNA, 120 bp, Lactobacillus floricola DSM 23037 A
gttcttaacattattcaaatgacatactgagttgaaatcaaacaaggatttattccaagttttatattttgaacctctttttgaggtcagacctctttcttaattgaaagaggttttttt

SEQ ID NO: 120 - DNA, 125 bp, Lactobacillus floricola DSM 23037 B
ttcattaaccttattgatttgacatactgagttaaaataaaacaatgcgtaagcaaagtttacacttattagccatttatagttggcaatacataaagaaagacctaggtcatatgacctaggtc

SEQ ID NO: 121 - DNA, 106 bp, Lactobacillus fuchuensis DSM 14340
accgataaactcattgatttgatactctgggttaaaatcaaacgaaaccttcgggttaagtttttacttctgagcctcgtatgaggcctttttttatgccttcatt

SEQ ID NO: 122 - DNA, 90 bp, Lactobacillus futsaii JCM 17355
gttttactatttctagattctttaagatctacaaaaataaggatttattccgaatttaccacctattttaattaataggtggtttttttt

SEQ ID NO: 123 - DNA, 112 bp, Lactobacillus gasseri K7
acactaaactttattgatctaacaaccagatttaaaatcaagcaatgcatcttttgatgcaaagtttcaatacttgtcccgagctatcgagggactttttttatgcaaaaaa

SEQ ID NO: 124 - DNA, 92 bp, Lactobacillus graminis DSM 20719
gaaatactcattgatttgatactctgagttaaaatcaaacaaggtctttggaccaagttttctattctgagcctcttatgaggccttttttt

SEQ ID NO: 125 - DNA, 138 bp, Lactobacillus hammesii DSM 16381
ccgcttgatcttactgaattgtcactaagagttaaagtcagacaaggtggtttaccaccaagttttatcttatgagcccgttatcgagccatacatatcttgttagagtcctttgctgaatgcgtcagcgaaggactc

SEQ ID NO: 126 - DNA, 112 bp, Lactobacillus hominis CRBIP
actctaaactttattgatctaacaaccagatttaaaatcaagcaatgcatcttttgatgcaaagtttcaacacttgtcccgagctatcgagggactttttttatacaaaaaa

SEQ ID NO: 127 - DNA, 141 bp, Lactobacillus hordei DSM 19519 A
ggattaacattattggtttaacgtcttgttttaaaatcaaacaaaacactttagtgttgagttttaacttttgacccactttattagtgggcagtacataaaaaaggaatcactcttataatgaggagtgattcctttttt

SEQ ID NO: 128 - DNA, 83 bp, Lactobacillus hordei DSM 19519 B
gttttgttgataggaaaatgattgagaatctacaaagataaggctttatgccgaaattactgcctttttggcagttttttttt

SEQ ID NO: 129 - DNA, 115 bp, Lactobacillus jensenii DSM 20557
acatttcaatttactgatttaacaaccttatttttaaaatcaagcaaggctttcgggccgagttttcacatgtgtaccgcttatagcggtctttttttttgcagtaaataaaaaa

SEQ ID NO: 130 - DNA, 112 bp, Lactobacillus johnsonii DPC 6026
catctaaactttattgatctaacaaccagatttaaaatcaagcaatgcatcttttgatgcaaagtttcaatatttgtcccacgttatcgagggactttttttatacaaaaaa

SEQ ID NO: 131 - DNA, 94 bp, Lactobacillus lindneri DSM 20690
cattttaatctcattagaatgacgtactgagttaaaatcaaacaaagccttatgctgagttttatcttttgagcccttaagggccatacatata

SEQ ID NO: 132 - DNA, 82 bp, Lactobacillus mali ATCC 27304
gttttattgataggaaaatgattgagaatctgcaaagataaggctttatgccgaaattactgcctcttaggcagtttttttt

SEQ ID NO: 133 - DNA, 92 bp, Lactobacillus mindensis DSM 14500
gctcttaagtaattgagatgacttactgagttaaaataaacattaaagttaaatgaccttctggtcggctcccgcgtgggggctattttttt

SEQ ID NO: 134 - DNA, 104 bp, Lactobacillus mucosae DSM 13345
aggaataacatcattgatttaacatccagagttaaagtcaaacaatgcattctgcaaagttatttcttctgacccatttattaatgggcaatacatattaaaaa

SEQ ID NO: 135 - DNA, 140 bp, Lactobacillus namurensis DSM 19117
ctgtttgaccttatagatttaccactcagagttgaaatcaaacaagatgctttagcatcaagtttcccattgtgagcccgttatcggtgccatacatattaaaacgaccaagccaccttttcgtgacttggtcgtttttt

SEQ ID NO: 136 - DNA, 90 bp, Lactobacillus nantensis DSM 16982
gttttactgtttctaaatctttgaagatctacaaaaataaggatttattccgaatttaccacctattttaaaaaataggtggtttttttt

SEQ ID NO: 137 - DNA, 96 bp, Lactobacillus nodensis DSM 19682 A
gttttactgttactaaattcttgagaacctactaaaataaggatttattccgaatttaccacctattttttaataggtggtttttttttacaaaaa

SEQ ID NO: 138 - DNA, 96 bp, Lactobacillus nodensis DSM 19682 B
ttgttcaaactacatgaaatgacgtactgagttaaaatcaacatttatgttaaatagtctcaattgactggctcccgcgtgggggctatttttttt

SEQ ID NO: 139 - DNA, 136 bp, Lactobacillus oligofermentans DSM 15707
cacatcgaattcattgatttgatactctgagttaaaatcaagcaaggcgcaagccaagtttaatcttctgagtcctgtatgggaccatacataaagagcgttattgatttcattatcaataacgctctattttatt

SEQ ID NO: 140 - DNA, 140 bp, Lactobacillus otakiensis DSM 19908
atgtttgaccttattgatttaacatcctgtgttaaaatcaagcaatgcgctttgcgcggagtttccacttttgacccattatatgggcattacataagctaaaggaaccattcttcgatttggagaatggttcctttttt

SEQ ID NO: 141 - DNA, 110 bp, Lactobacillus ozensis DSM 23829
attataacatctatgtatttgaaatgtattaatgcatcaaaatcttagatcacaatttctataatatacgtaaaacagcaaattttactttataagaatttttatatttt

SEQ ID NO: 142 - DNA, 109 bp, Lactobacillus paracasei subsp paracasei 8700:2; identical to SEQ ID NO: 109

SEQ ID NO: 143 - DNA, 108 bp, Lactobacillus paracasei subsp tolerans Lpl7
cgttttgaactgattgattcgacatctacacgttgagatcaaacaaagcttcggctgagtttcaatttttgagcccatgttgggccatacatacgccatccgggaaaa

SEQ ID NO: 144 - DNA, 69 bp, Lactobacillus paracollinoides DSM 15502
acttaataacctcattgatttgatattcagagttaaaatcaaacaaggcttatgccaagttttctcttt

SEQ ID NO: 145 - DNA, 140 bp, Lactobacillus parakefiri DSM 10551
atgtttgaccttattgatttaacatcctgtgttaaaatcaagcaatgcgctttgcgcggagtttccacttttgacccattatatgggcattacataagcgaaaggaaccattcttcgatttggagaatggttcctttttt

SEQ ID NO: 146 - DNA, 109 bp, Lactobacillus pentosus IG1
acacttgaccttattgatttaatgtcctttatttgaaatcaaacaacaccattcatggtgaagttttcacacctgtccatcctatatatatggacacctacataaaaaa

SEQ ID NO: 147 - DNA, 117 bp, Lactobacillus pentosus KCA1
gttctaaaccttcttgatatgactactagcgtcaagatcaaacaaggcattttgccgagtttcaccttttgagtccgtattcggaccattacatatgtatcaagatgtcgcccattt

SEQ ID NO: 148 - DNA, 103 bp, Lactobacillus plantarum EGD-AQ4
gttctaaaccttcttgatatgactactagcgtcaagatcaaacaaggcattttgccgagtttcaccttttgagtccgtattcggaccattacatatgtatcaa

SEQ ID NO: 149 - DNA, 106 bp, Lactobacillus psittaci DSM 15354
acaatctcaacatttcaatttactgatttaacaacctgatttaaaatcaagcaaggtcttcggaccgagttttcacatttgtaccgcttatagcggtctttttttt

SEQ ID NO: 150 - DNA, 93 bp, Lactobacillus rennini DSM 20253
attgaaagattcattgatttgatactctgagttaaaatcaaacaaaccttcgggtgagtttttacttctgagcctcgtatggggccttttttt

SEQ ID NO: 151 - DNA, 109 bp, Lactobacillus reuteri mlc3
ctactaaatattattgatttgaagtacagagttaaaatcaaacaagtgcttcagcacaagtttctacttttgagtcagttatctgaccaatacataaaagggaattaaa

SEQ ID NO: 152 - DNA, 110 bp, Lactobacillus rhamnosus GG
caacttgaattgattgatctgacatctacgagttgagatcaaacaaagcttcagctgagtttcaatttctgagcccatgttgggccatacatatgccacccgagtgcaaa

SEQ ID NO: 153 - DNA, 110 bp, Lactobacillus rhamnosus GG; identical to SEQ ID NO: 152

SEQ ID NO: 154 - DNA, 143 bp, Lactobacillus rossiae DSM 15814
acttttgaccctattgatctgacatacagcgttaaaatcaagcaaggctttcgagccaagtttaaatctttgggttcgctattcggaccgtacatagtaaaagggcgtcatcgagttcaaattcgatggcgccctttagtttt

SEQ ID NO: 155 - DNA, 103 bp, Lactobacillus ruminis ATCC 25644
acgtaaaacatcattgatatgacatccagaagttgaaatcaagcaagacttaaagtcaagcttctacttttgattcacgttttgtggacagtacatattgaca

SEQ ID NO: 156 - DNA, 95 bp, Lactobacillus sakei carnosus DSM 15831
accgaaatactcattgatttgatactctgagttaaaatcaaacaaggtcttttgaccaagttttctattctgagcctcttatgaggccttttttt

SEQ ID NO: 157 - DNA, 119 bp, Lactobacillus salivarius UCC 118
ggttttgacctcattgatttaacattctgagttgaaatcaaacaaggcttttatagctgagtttttctttttgatccatatatatggactatacataaaaaggagtcatctgactcctt

SEQ ID NO: 158 - DNA, 99 bp, Lactobacillus sanfranciscensis DSM 20451
attttaatctcattagaatgacgtactgagttaaaatcaaacaaggtcttgtgccaagttttatcttctgagcccttaagggccatacatataagaaaa

SEQ ID NO: 159 - DNA, 128 bp, Lactobacillus saniviri DSM 24301
acgtttaacctatttgatctgacattcaaggttaaaatcaaacaaggcttcggccaagttttattcttagggctcgctatcgagccatacataaaaacacacccgtttcggcgggtgtgttttctttt

SEQ ID NO: 160 - DNA, 129 bp, Lactobacillus senmaizukei DSM 21775
acgcttgactctattgatttgtcactgaaagttaaaatcaagcaaggccttgtgccaagttttactttttgagcccggtatcgagccatacatagtcggcccttccagtcatgtggaagggccgttttt

SEQ ID NO: 161 - DNA, 86 bp, Lactobacillus tucceti DSM 20183
gttttactattactaaattcttaaggatctacaaaaataaggatttattccgaatttaccacctacttgttaggtggttttttttt

SEQ ID NO: 162 - DNA, 167 bp, Lactobacillus versmoldensis DSM 14857
atgttctaagtaattgagatgacttagagaattaaaatcaacattaaagtaaatcgatcattttgattgggcccaatggggcctatttttttgctctgaatttttagtcgatatgtttaattgatttaaataatccggttggtgattcataaataaaatcagttttt

SEQ ID NO: 163 - DNA, 143 bp, Lactobacillus zymae DSM 19395
ctgcttgaccttctagatttaccactcagtgttaaaatcaaacaagatactgcggtatcaagttttcctttttgagctcgttatcgagccaatacataattaaacgaccaactcactggcagtccaatgagttggtcattttt

SEQ ID NO: 164 - DNA, 140 bp, Leuconostoc gelidum JB7
ggtttaacctcattgatctgatacacaatattgaagtaacgcaaggctttatgccaagcttaattactcatcaagagtggccttatggccgtacataaaatcccgtgttgttacaaaacagcacgggatttctttttatt

SEQ ID NO: 165 - DNA, 145 bp, Leuconostoc pseudomesenteroides 4882
gtatagaaaccattgatctgacatacaaagttgaagtaacgcaaggcgtcagccaagcttattgactctttacgagtggccctatggccgtacataaaatcccgtgttgcctttgcaacacgggatttatctttattcatccttt

SEQ ID NO: 166 - DNA, 143 bp, Oenococcus kitaharae DSM 17330
gggttctacctcattgatctgacacacagcattgaagtaaagcaagattaatttcaagcttaattttcttcacattttatgtgcagaagggcttatgcccacaatacataaaaagtccgcattcacttgcggacttttatttt

SEQ ID NO: 167 - DNA, 143 bp, Pediococcus inopinatus DSM 20285
tattttaactatattgatttgacgctctgagttaaaatcaaacaaagcttcggctgagttttatcttttgaggccgctatcggcccatacatattttattcaagaaaagctattgacggttatcaaaccaccaatagcttttt

SEQ ID NO: 168 - DNA, 140 bp, Pediococcus lolii DSM 19927
acttttaaccttattgatttaacatcctgatttgaaatcaaacaatgcactttgtgcggagtttatccatttgtcccagctatctgggcaatacatagtgaaagaggaaccgacccttaatgggacggctcctctttttt

SEQ ID NO: 169 - DNA, 140 bp, Pediococcus parvulus DSM 20332 A; identical to SEQ ID NO: 168

SEQ ID NO: 170 - DNA, 149 bp, Pediococcus parvulus DSM 20332 B
tattttaactatattgatttgacgctctgggttaaaatcaaacaaagctttatgctgagttttatcttttgagtccgctatcggaccatacataattttattaagaaaagctattgaaggttattaaaccgacaatagcttttcttttt

SEQ ID NO: 171 - DNA, 137 bp, Pediococcus stilesii DSM 18001
acaattgaatttacttctttaacatcctaatttgaaatcaagcaatgcacttcggtgcggagtttacacatttgtcgtctttataggcgcgtacataaagaaaagaggaacgttccttaatggaagttcctcttttt

SEQ ID NO: 172 - DNA, 119 bp, Steptococcus agalactiae GB00300
ttgttggaactattcgaaacagcacagcgcgttaaaataaggcagtgattttttaatccagtccgtattcagcttgaaaaagtgagcaccgattcggtgcttttttttatgtcattgtt

SEQ ID NO: 173 - DNA, 119 bp, Steptococcus gallolyticus ATCC BAA-2069
ttgttggagctattcgaaacaacacagcgagttaaaataaggctttgtccgtacacaacttgtaaaagtggcacccgattcgggtgcgtttttttgtgcccttacaaataatttcaaca

SEQ ID NO: 174 - DNA, 102 bp, Steptococcus henryi DSM 19005
cttgcacagttacttaaatcttgctgagcctacaaagataaggcttcatgccgaaatcaagcacccccgtttttaacgaggggtgcttttcgttatgtaaaa

SEQ ID NO: 175 - DNA, 110 bp, Steptococcus mutans NLML5
cttacacagttacttaaatcttgcagaagctacaaagataaggcttcatgccgaaatcaacaccctatctattataagatagggtgttttcgttttatagaggagatttt

SEQ ID NO: 176 - DNA, 119 bp, Steptococcus oralis SK304
ttgttggaactattcgaaacaacacagcaagttaaaataaggctttgtccgtacacaacttgaaaaagtgcgcaccgattcggtgctttttattttattatactaactcattgtactcc

SEQ ID NO: 177 - DNA, 105 bp, Streptococcus anginosus 1_2_62CV
cttacacagttacttaaatcttgcagaagctacaaagataaggcttcatgccgaaatcaacaccctgtctatgacggggtgttttcgtgttgtaaaggagttttt

SEQ ID NO: 178 - DNA, 119 bp, Streptococcus anginosus DSM 20563
atgttggaatcattcgaaacaacacagcaagttaaaataaggctttgtccgtactcaacttaaaaagtgcgcaccgattcggtgcttttttatttcaatcaagaacacaaaaaaacagc

SEQ ID NO: 179 - DNA, 119 bp, Streptococcus dysagalactiae subsp equisimilis
ttgttggaaccattcaaaacaacgtagcaagttaaaataaggctagtccgttatcaacttgaaaaagtggcaccgagtcggtgctttttgtatctttattttaccttgtcaataaacta

SEQ ID NO: 180 - DNA, 119 bp, Streptococcus equi subsp zooepidemicus
cctatggaactattcaatacagcatagcaaagttaaaataaggctttgtccgtaatcaacctgaaaaggggagcaccgaatcggtgcttttttactttctaccaactctaccaatactt

SEQ ID NO: 181 - DNA, 99 bp, Streptococcus gordonii Challis substr CH1
cttacacagttacttaaatcttgcagaagctacaaagataaggcttcatgccgaattcaacaccctgtcatttatggcggggtgttttcgatttgtaaa

SEQ ID NO: 182 - DNA, 109 bp, Streptococcus infantarius subsp infantarius
cttgcacggttacttaaatcttgcagagcctacaaagataaggcttcatgccgaattcaagcaccccatgtttacatggggtgcttttcgttgtgtaaaaaggagagta

SEQ ID NO: 183 - DNA, 106 bp, Streptococcus intermedius B196
cttacacagttacttaaatcttgcagaagctacaaagataaggcttcatgccgaaatcaacaccctgtctatgacggggtgttttcgtgttgtaaaggagttttta

SEQ ID NO: 184 - DNA, 119 bp, Streptococcus lutetiensis 033
ttgttggaactattcgaaacaacacagtgagttaaaataaggctttgtccgtacacaacttataaaagtggcacccgattcggatgcattttttatttgtgattcaaatagatataaca

SEQ ID NO: 185 - DNA, 119 bp, Streptococcus mitis SK321
tcgttggaactattcgaaacaacacagcaaagttaaaataaggctttgtccgtacacaacttgaaaaagtgcgcaccgattcggtgcttttttgttttactatactaatttattctact

SEQ ID NO: 186 - DNA, 119 bp, Streptococcus mutans TA 159
gtgttggaatcattcgaaacaacacagcaagttaaaataaggcagtgatttttaatccagtccgtacacaacttgaaaaagtgcgcaccgattcggtgcttttttatttgctttactgt

SEQ ID NO: 187 - DNA, 100 bp, Streptococcus orisratti DSM 15617
cttgcacagttacttaaatcttgcagagcctacaaagataaggctttatgccgaaatcaagcaccccgtttatacgaggtgcttttcgttttaaataaaa

SEQ ID NO: 188 - DNA, 99 bp, Streptococcus parasanguinis F0449
cttacacagttacttaaatcttgcagaagctacaaagataaggcttcatgccgaattcaacaccctgtcatttatggcggggtgttttcgttttgtaaa

SEQ ID NO: 189 - DNA, 119 bp, Streptococcus salivarius K12
ggtttgaaaccattcgaaacaatacagcaaagttaaaataaggcttagtccgtattcaacttgagaaagtggcaccgattcggtgcttttttgctgcacaaagagtcccttggaattat

SEQ ID NO: 190 - DNA, 119 bp, Streptococcus sanguinis SK330
ttgttggaactattcgaaacaacacagcaagttaaaataaggctttgtccgtacacaacttgaaaaagtgcgcaccgattcggtgcttttttaattactacaggtgcttttttaattac

SEQ ID NO: 191 - DNA, 102 bp, Streptococcus vestibularis ATCC 49124
cttacacagttacttaaatcttgcagaagctacaaagataaggcttcatgccgaaatcaacaccctgtcattttatggcagggtgttttcgttatttaaaaa

SEQ ID NO: 192 - DNA, 98 bp, Lactobacillus composti DSM 18527
aatcttgaatctattgatctgacatacagcgtcagaataaaacaaggccatcggccaagtttacagcgctctttttgagagtggggcttatgcccata

SEQ ID NO: 193 - DNA, 67 bp, Lactobacillus concavus DSM 17758
tatcttaactttattgaaatgacactctgttaaaatcaaacaaggcttcggccaagttttccctttt

SEQ ID NO: 194 - protein, 1239 aa, Bifidobacterium bombi
MSQHRRYRIGIDVGLNSVGLAAVEIDANHDNPLDEIPISILNAQSVIHDGGVDPDEAKSATSRRASAGVARRTRRLHKSKRQRLAKLDEVLNELGYPVEDESQFPAGSNPYIAWQVRAKLAETFIPDVETRKRMISIAIRHIARHRGWRNPYSSVADAERMSHTPSPFMVEYAKKLDFEINDRRTNGFYHSPWQSVDEEGKRLSKSELEKQPKIEDWNDNPINGKTIAQLVVSSLEPQTKIRRDLTHGLQTESTLNIQTEKLHQSDYIHELETIFERQHVDQTTQEQLLEATFHTKNPKAVGAAAKLVGKDALDSRYYRASRATPAFEEYRVMAAIDTLRIREHGTERQLTTDERRKLFDFIKGLPSKKTKNEPSISSLTWGDVADFLGIQRIDLRGLGSLKDGEPVSAKQPPVIETNDIMQKAPDPIAAWWSQANTKERDRFVEFMSNAGAIKDTSDEVRNIDAEISQLLEELTGSELESLDKITLTSGRAAYSSQTLRNITNYMYETGCDLTTARQELYHVGKNWAPPAPPIYEHTGNPSVDRTFSIIHRWLCNMRDQYGEPETVNIEYVRDGFSSTSTQLAEQRERDRRYADNLKMLSNYEGASSRSDVRRIKALQRQNCQCIYCGRTITFETCQMDHVLPRKGPGSDSKFENLVATCGECNKSKSDTLYMNWAKTYPNTNLQDVLRRIQEWSKDGWMTDKRWRQYKEALILRLEATEKQEPLDNRSMESVSYMARELRNRIYGFYGWHDQDDALKQGRQRVFVSSGSMTAAARRTPFESPLIKGADEETYESSLPWLDGMKGKTRLDRRHHAVDASIIAMMRPQIVKILTEAQEIRSEQHDKYRKGQTPDYVCKRRDYWRNWRGTPDTRDEEVFNYWAGEQLRTLTDLVSQKMADDEIPVIYPTRLRLGNGSAHKDTVVSMMTRKVGDELSITAINKAESGALYTALTRDSDFDWKTGLSANPNRRIRVHDKWFEADDTIKFLEPAVEVVLKNNTRARIDPEALDKVHSTLYVPVRGGIAEAGNSIHHVRFYKIPKLNSKGKQTGSIYAMLRVLTIDLAMNQYDKETGKKQDLFTLPLPESSLSRRFSEPKLRQALIDGTAEYLGWAVVDDELEIPAFANARITEEQAINGSFTDRLLHSFPGTHKFRFAGFSRNTEIAIRPVQLASEGLIETDENRKRQQLRLTQPNTEYSNSIKNVLKSGLHLKVNTLFQTGILVTRANSQGKQSIRFSTVEE

SEQ ID NO: 195 - protein, 1121 aa, Bifidobacterium dentium LMG 11045
MSVGLAAIEVDETGFPIRILNIQSVIHDGGIDPQLGKKKSISRKAISGVARRTRRMRRRKVVRLRQLDATLESLGFPIVEPDSLDTWEIWLTRAKLASSYIQDDETRKEDVSIALRHIARHRGWRNPYSNVESLFVDVAPSEQYEELRRKAEEKLGTSLSGNPTSAEIVECILKRQVGEVQLRTRSRKGVNGNAVEKEGLLPTKLMQSDNAAEIRRIFKVQRIDDETGRKLLRAVFKACSPKGSVERRVGRDALAPGLPRALKASLAFQEYRIANVLTNLVISEDGTKRKLTIAEKQRVFGFLSSNETDDITWIDVAEKLGLERRQIQGVGCLTADGEERISSTPPRNITALHIHSAKPVIREKLVAWWKAASPTVRETMVELLSNTVDIDRVREDMDYSSAVAFIDSLGDEELTALDSVDLLSGRAAYSRQTLKQLTERMLNTDDDLHEARKAVFGVDDNWKPPVDAISTSVGNPAVDRVLKIVNRYLLACQKRWRNPQSVQIEHVRESFSSVAKAKETERVQGERARYRNDLRRELCEQEGLNKIRESDIRRWESVQRQNGTCLYCGSPITFRTCEMDHIVPRKGVGSTNTRVNLAAACAACNKLKSNTAFSVWARTEGAANRKVSQRDAIERVKTFIFNKSVPPREQRAFKQAVISRLRQAESDPAIDNRSIESVAWMADELHRRIEAYFNQDADVSGNTPATQVWVFQGRVTALARKASGIEGRIHFAGEWKKTRLDRRHHAVDAAVIAMMNHSAAQTLVERDSLRLSQWITRKPETWKNYPFSEGQKKTRFKEWLDCMNALLDLLNDALDSDRVPVTRCQRMSLGNSQAHAATIRKMKRVELFSPMDADLIRRASTPALYCALTRLPEYSPEKGLPENRGREIVLNGRHIRSTETVDFFASGAAQLMVRNGSAEIGDSIHHMRIYRYRKTGAKSQEYVYGMIRVFQIDLLHASSENLFAVQLPSQSVSVRYGDKNVVQAIQEGRAEYLGHIVPNDEILISYEGVRMKDSEKIGAYANDFSGTASELAQRRHWVVVGSDVSKLALRPSYLSEEGLENSGSESERLSKQTRKVIEGKGWVVAVNILAKYHPVVIRRNALGEPRFRTNSGMPVSWRWDR

SEQ ID NO: 196 - protein, 1390 aa, Bifidobacterium merycicum LMG 11341
MSRKNIVEDYAISLDIGNASVGWVAFTPNYRLVRAKGHELIGARLFEPASTAEERRMARTTRRRYSRRRWRLRMLDSMFDQALSEVDPSFLMRRKYSWVHPEDKNNEAHWFGGVLFDSNEQDKRFYEKYPTIYHLRKSLMEDDERHDIREVYLAIHHMMKYRGNFLTEGELAPSSVFDVEDFLKLLTEILQYADEGETDEDLELQADANGLTEALCTTKGSRSIRAKNAISILKEGAALSKRQEAIISAVFAGLEGNKLDLTKVFPNKEYTPEDKKTLALYFNKADYDEKRVAIGDSGLLEDNECDFLDCIRRQYSAIALKQLLGDFTSISESMCARYEQHQRNWDLIKRYCREESNAENINKNYGALVGWEIVGGQRRSIRGAKDYENKRKAANKFFEELIKGSALPDQEKERLLHDIENDELFPVQRDSGNGVIPYQLHLNELKKIIQKQGRYYPFLLETYIKDGKEVNKLEGLLAFRVPYYVGPLVSRDDMQSSDNRENHWMIRRKKGVITPWNFDEMVDKDKSGHEFIKSLVGTDSYLLGETTLPKNSLLYQEFEVLNELNNVRLSIRTGNHWADKRRVRLGHNEKKLLLEELFAKQATVTKKAAENLLRRTYGNTYEISGLADEKKFVSSLSSYGKMCRTLKASYVNSHKDVVEKIIELQTVFEDKKTLKHQLQLLGELAETNCELLSNTHYTGWGKLSRKLLTSKVVVCKIGNDFAPAKHSIIEIMRETDRNFMEIITDKDLGVGEWINQQNVGAEDGNSYQDIIDDLRVSPKVKRGINQAIRVIDDISKAVGKEPSRIFLELAGDVQQSARTVSRKSRLQGLYKSAGLQKEFRDLAESLNECSDNDLRDDRLFLYYTQLGKDMYTGEPLNLDRLSSDYDIDHIIPQAVTQNDSLDNRVLVARVANARKTDSFQYLPEIANRMRNFWQELLDAGLISRVKFDRLNRQNDFSSHEKERFVQRSLVETRQIMKNVATIMRKRYGNSAAVIGLNSELTKEMRQYLGFSHKNRDINDYHHAQDALCLGIAGQFAVNRGFFANGMVSDGAVNSYNLYLQDYLRGYREKMSAGERRRNKAFGFIVGSMNSQDSDKRINPKTGEIAWDDEDKVYLRKVMNYRKMLITQKVGDSFGALYNETRYGTSAKEGVNGIPFDKHKQDTALYGGFSSAKTVYVVLIEAKKKTRLVNITMQEYAELGDHPSDDALRAVLAKKKPEYGKARILLRHIPPMQLIRYGGALVTVKSATELNNAQQLWLPYKEYCLFDDVISSAIDVDEARLCQMLDVILDAIQKYYPKQRFDETGLSAFHNAFNEVSAEDKKRIVGEMVGMLHADAKNANLKALGMSGRWGRMSNQSGYTFADSDEFIFQSPSGLFEKRISVGELKKRRAR

SEQ ID NO: 197 - protein, 1344 aa, Kandleria vitulina DSM 20405
MSQNNNKIYNIGLDIGDASVGWAVVDEHYNLLKRHGKHMWGSRLFTQANTAVERRSSRSTRRRYNKRRERIRLLREIMEDMVLDVDPTFFIRLANVSFLDQEDKKDYLKENYHSNYNLFIDKDFNDKTYYDKYPTIYHLRKHLCESKEKEDPRLIYLALHHIVKYRGNFLYEGQKFSMDVSNIEDKMIDVLRQFNEINLFEYVEDRKKIDEVLNVLKEPLSKKHKAEKAFALFDTTKDNKAAYKELCAALAGNKFNVTKMLKEAELHDEDEKDISFKFSDATFDDAFVEKQPLLGDCVEFIDLLHDIYSWVELQNILGSAHTSEPSISAAMIQRYEDHKNDLKLLKDVIRKYLPKKYFEVFRDEKSKKNNYCNYINHPSKTPVDEFYKYIKKLIEKIDDPDVKTILNKIELESFMLKQNSRTNGAVPYQMQLDELNKILENQSVYYSDLKDNEDKIRSILTFRIPYYFGPLNITKDRQFDWIIKKEGKENERILPWNANEIVDVDKTADEFIKRMRNFCTYFPDEPVMAKNSLTVSKYEVLNEINKLRINDHLIKRDMKDKMLHTLFMDHKSISANAMKKWLVKNQYFSNTDDIKIEGFQKENACSTSLTPWIDFTKIFGKINESNYDFIEKIIYDVTVFEDKKILRRRLKKEYDLDEEKIKKILKLKYSGWSRLSKKLLSGIKTKYKDSTRTPETVLEVMERTNMNLMQVINDEKLGFKKTIDDANSTSVSGKFSYAEVQELAGSPAIKRGIWQALLIVDEIKKIMKHEPAHVYIEFARNEDEKERKDSFVNQMLKLYKDYDFEDETEKEANKHLKGEDAKSKIRSERLKLYYTQMGKCMYTGKSLDIDRLDTYQVDHIVPQSLLKDDSIDNKVLVLSSENQRKLDDLVIPSSIRNKMYGFWEKLFNNKIISPKKFYSLIKTEFNEKDQERFINRQIVETRQITKHVAQIIDNHYENTKVVTVRADLSHQFRERYHIYKNRDINDFHHAHDAYIATILGTYIGHRFESLDAKYIYGEYKRIFRNQKNKGKEMKKNNDGFILNSMRNIYADKDTGEIVWDPNYIDRIKKCFYYKDCFVTKKLEENNGTFFNVTVLPNDTNSDKDNTLATVPVNKYRSNVNKYGGFSGVNSFIVAIKGKKKKGKKVIEVNKLTGIPLMYKNADEEIKINYLKQAEDLEEVQIGKEILKNQLIEKDGGLYYIVAPTEIINAKQLILNESQTKLVCEIYKAMKYKNYDNLDSEKIIDLYRLLINKMELYYPEYRKQLVKKFEDRYEQLKVISIEEKCNIIKQILATLHCNSSIGKIMYSDFKISTTIGRLNGRTISLDDISFIAESPTGMYSKKYKL

SEQ ID NO: 198 - protein, 1352 aa, Lactobacillus agilis DSM 20509
MSEKEYHLGLDIGTNSIGYAVMDCNYHLMRAKGKTLIGTSLFREGNTAAERRGYRTTQRRLKRRKRRLKLLEAFFDPYIFEVDENFLARLHEADISPKDENKRFWGSLLFPNEKDANFYRKYPTIYHLRKALMEEDRKFDVRAIFLAIHHIMKYRGNFLSPLSVDSFKQEGLELKEQLDRQLKRVAELYNELNTDVKINVSDVETIQDIIIDKNKSRRDKAGALKKLLAVSSDRKEINKLNASLAKELSNAILGMKAQFANLLLADDLEIDKNKKNFSLLDTNAEENVSGLLELVNEKQAELFDAIKTIHDQIILNEIVPDGKSISQSMVDKYEAHREQLQVLKALYEKMDAKQIKAIKKAYSLYIDGKDPKAKKVDKRAHQNRADFYKEVKKVLVELDDSRAEKLLGLIEMGQFLPKQRTAMNGVIPNQLHQVELDKIIEMQSKYYPWLAEKNPVKSHQKRAPYKLDELLTFRVPYYVGPMVTSKKQQQTSNSNFAWMVRKQEGEITPWNFEEKVDTIASANDFIKRMTAKDTYLVGEDVLPANSLLYQRYKVLNELNNIKVNGRRLPVELKREAYVALFENGDSKTVSAKCFKNWLNVKLKNLNSLKLEGLSTGTKFDNNLSTYHDLKKIFGKAVDDAGRQKDFEQIIEWLTIFEDKKILRIKLKEIEWLTEENITQLTRLNYNGWGRLSRRLLTGICDSNGQRIMDWLWDTTNNFMQIQSQPDFQKAIVEYNSDKLEQGDIEQILGEAYTSPQNKKAIRKVIKVVQDVEKAMGAKPTSISIEFTRSDGRSELTNSRMTQLQKTLMSLSEEMTDQALLAEFKDFQASKKKLTNKYYLYFTQLGRDMYTGEPLNIDQLSLYSDGDHILPRSFIKDDSLDNRVLTKRAVNNEKSDTVPVCEYGAKMKDFWNDLYDNGLISKQKLANLLTDPDEIGPYKANGFIRRQLVETSQVIKLSAEILQTLYQDTKIIEVRQKYTHELREHFNFVKIRQLNDYHHAFDAYLTAFSGRYLYQRYPKLRGYFVYGDYNKFDAKKDRNYLKSYNFLYDLEEGKTDQIVDNVEHKVFMNRQDAINQLKKAYEYKYMLVSQETYTNSGAMFKETIYPVNPKQKLIQKKNDKPVDIYGGYSNNYDAYLSIVRLEDKKGIKFRVVGIPMRNKAELDNLAKEDHNGYMQRLNEIVDEQINSSGKKKTFRIILPKVHFKQLVEDDSGKFMLGSAAYPYNAKQLVLSVKSIESLANKDASDRELVAVYEEILNVVNDKFTLYDARQFRNKLTSSKDKFVELNTADKVTELLDILDGLHANPVVKKLKIISGSPFGFLQRPSGIVLTENAKLIYQSPTGIFERVVYLRDL

SEQ ID NO: 199 - protein, 1318 aa, Lactobacillus animalis DSM 20602
MGSNMLKKDYSIGLDIGTNSVGHAVVTDDYKVPTKKMKVFGDTSKKTIKKNMLGVLLFNEGQTAADTRLKRGTRRRYTRRKNRLRYLQEIFAPELAKVDPNFLYRLEESSLVAEDKKYDVYPIFGKREEELLYHDTYKTIYHLRSALANNDQPADLRLVYLALAHIIKYRGNFLLEGEIDLRTTDINKVFAEFSETLNENSDENLGKLDVADIFKNNTFSKTKKSEELLKLSGAKKNQLAHQLFKMMVGNMGSFKKVLGTDEEHKLSFGKDTYEDDLNDLLAEAGDQYLDIFVAAKKVYDAAILASILDVKDTQTKTVFSQAMIERYEEHQKDLIELKRVFKKYLPEKCHDFFSEPKISGYAGYIDGKVSEEDFYKYTKKTLKGIPETEEILQKIDANNYLRKQRTFDNGAIPHQVHLKELVAIVENQGKYYPFLRENKDKFEKILNFRIPYYVGPLARGNSKFAWLTRAGEGKITPYNFDEMIDKETSAEDFIKHMTINDLYLPTEPVLPKHSLLYERYTIFNELAGVRYVTENGEAKYFDAQTKRSIFELFKLDRKVSEKMVIKHLKVVMPAIRIQALKGLDNGKFNASYGTYKDLVDMGVAPELLNDEVNSEKWEDIIKTLTIFEGRKLIKRRLENYRDFLGEDILRKLSRKKYTGWGRLSAKLLDGIYDKKTHKTILDCLMTEDYSQNFMQLINDDNYSFKETIKNAQVIEKEETLAKTVQELPGSPAIKKGILQSLEIVDEIIKVMGYKPKSIVVEMARETQKTHGTRKREDRVQQIVENLKDANELPEKLPSNAELSDERKYLYCLQNGRDMYTGAPLDYDHLQFYDVDHIIPQSFLKDDSIENKVLTIKKENVRKTNGLPSEAVIQKMGSFWKKLLDAGAMTNKKYDNLRRNLHGGLNEKLKERFIERQLVETRQITKYVAQLLDQRLNYDGNGVELDEKIAIVTLKAQLASQFRSEFKLRKVRALNNLHHAHDAYLNAIVANLIMAKYPELEPEFVYGKYRKAKFKGLGKATAKNTLYANVLYFLKENEVYPFWDKARDLPTIKRYLYRAQVNKVRKAERQIGGFSDEMLVPKSDSGKLLPRKEGLDPVKYGGYAKAVESYAVLITADEVKKGKTKKVKTLVNIPIIDSKKYEADPTAYLASRGYTNVTNSFILPKYSLLEDPEGRRRYLASFKEFQKANELILPQHLVELLYWVNAKDGEQKLEDHKAEFKELFDKIMEFADKYVVAPKNSEKIRRLYEENQDATPMELGKNFVELLRYTADGAASDFKFFGENIPRKRYNSAGSLLNGTLIYQSKTGLYETRIDLGKL

SEQ ID NO: 200 - protein, 1316 aa, Lactobacillus apodemi DSM 16634
MLQKNYTIGLDIGTNSVGYAVINDNYKVPAKKMKVLGNTDKKTIKKNLMGVLLFDAGETAATTRLKRGTRRRYTRRRNRLRYLQEILGPELAKVDANFLHRLAESSLVTEDKEFSAYPIFGDREEELLYHKTYKTIYHLRSALANKDEKADLRLIYLALAHIIKYRGNFLIEGEIELSDTDIDKVYADFCRSFNELFDTEVLQEIEVEAIFKDKTLSKTKKAEELVKVSGVKKNQVAHQFLKMMVGNTVNFKKVFNLTEDQKLSFGTDSYEDELNDLLAKSDDRYLDVFVAAKKVYDTAILANILNTKNSVATKTIFSQSMIERFKDHQKDLKELKQLFKTYLPEKYPDFFGNSKEDGYAGYIEGKTNEEKFYTHTKKILKNIPQAASVLAQIDVGNYLRKQRTFDNGVIPHQIQLKELLAIIENQGKYYPFLLENKEKIAKILTFRIPYYVGPLARGNSRFAWLKRVGKEKITPFNFENVVDLESSAERFIERMTLNDLYLPEEKVLPKHSMLYEKFSIFNELAGIRYITDNGEMKFLDAQTKQSIFELFKQERTVKEKKVLDLLKTLMPSERVVAIKGIDNGKFNASFGTYHDLSKMGFKTEKIASESNQARWEEIIKTLTIFEDRKLIKSRLRKYDDFLNEKEIGALSKRKYTGWGRLSAKLIDGIYDKKTHQTILDFLMNEDYNQNFMQLISNDNYSFKKIIEDSQVIKEEGSLTEVIQELPGSPAIKKGILQSIEIVDELVKVMGGNPKKIVVEMARETQKTHGTTRREARIKEIIKNLNKLKLNELPKDLPSNEELSDEKVYLYCLQNGRDMYTGAPLDLDNLSQYEVDHIIPQSFLKDDSIENKVLTAKIENSRKTNGLPSVEIAKKMGAFWRSLLKVGAISEKKYRNLRRSLHGGMTEKLKETFVKRQLVETRQITKYVAQILNSRFNEEKNEDKVAIVTLKAQLTSQFRKDFELYKVREINNLHHAHDAYLNAVLATLLMTSFPELEPEFVYGKYRKTKFKGLGKATAKNNLYTNILQLLKEESAQYWDTKERDLATIKKNVYQAQVNKVRKVERQTGSFYDETVAKKSASQKLFPRKNGLDPVKYGGYQRANEGYSLLFRADMLNKRGKTKSVKTLVKIPIIESAQYLADPTEYLAKRGYYNVSEHSLLLPKFSLLENNNGLRRYLASSNEFQKANELILPKHLVRLLYWSQSKQRKEELNKHRAEFAELFTYIMDFADKYVVAPKNSEKIKNIYENNKDSSVEVLGKNFIELLKYTADGAASDFTFFDTKIPRKRYNSAGDLLDGTLIYQSKTGLYETRIDLGAI

SEQ ID NO: 201 - protein, 1377 aa, Lactobacillus brevis subsp gravensis ATCC 27305
MESNHDGEQVKYTLGLDIGTSSIGYAAIDKHQKPIRAKGKHVIGVRLFQEGQTAADRRAFRTTRRRLKRRKWRLNLLNRLFDPYLSEVDPNFLPRLRQSNLSPKDDNKHFNGSTLFPDKTDAAFYRQYPTMYHLRYALMTEKRKFDIREVYLAIHHIVKYRGNFLNSATVDSFKTSNIDFTSQFDRLNELYRQVILDEPFQINMDQVDEMTNKLLDNDALKLDTQKQVAKLLPVIYNDKPIDKQYTRIATEFSKAILGYKTKLDVILNLDTQNAKDWVIRLDDEDIDDKLPALVENLDESRQEIVTIIRDLYAQITLNAIVPKGKSLSESMVDKYNDHKDHLDLLMGLIHELGDDSAKGIKLREAYTQYVGKSDDKTLNQDDFYAAIKKNLDEDSKRSPKIQRLIEQASFMPKQRTSANGVIPHQLHQLELDRIIENQGRYYPFLKKPNPNTHKPNGGKYKLDELVAFRIPYYVGPLITKRDQEKTSGADFAWMIRKPGQEGEITPWNFDQKVDRMASANRFIRRMTTKDSYLVAEDVLPDASLIYEKFKALNELNMLKVNDSRLSPSQKQDLFNNLFKKQKTIRTKKLQTYIRTNWELPSVMISGLADPDKFNSSLSTYIDFRDIFGEKVDDPNRQADYEEIIEWSTVFEDRKIYQAKLNQLDWLTEPQRKALLTKRYTGWGRLSKKLLTGLKDQNGDSILDQLWKTNDNFMQIQSRDEFAKQIHDENAKQFHEANNVDDILDDAFTSPQNKKAIRQVDKVVQDVVKAVGYAPDKIAIEFTRSLENNPQRTVSRQRQLQAAYKNIPREIMKSGLMAELGSVADSKKVLSDKLYLYFTQMGKDMYEDKTINIDNLPNYDIDHILPQAFIKDDSIDNRVLISKEENARKSNRVPLKFFGAKRMGFWKDLLNNGLISNRKFQNLTTDPEKISKYSAKGFIHRQLVETSQVIRLVANILGNEYSQAGTTIIEVSAKMNRQLREDFHLIKNRNVNDYHHAMDAYLTAYVGDYLYLRYPKLRPYFVYGDFKKAEDQDLNIRNFNFLHDLKDNESLDKIVDSETGEIVWEKHGSVKQLKKVYHYKFMLVSQEVYTRQDALFNQTIYPASDADKRKLIPIKNSKPVDVYGGYSGNIDAYMAIVRVHGKKEDNYKVVGIPMRAVTKLKKAEKEGHDSYLNAVHEVLKPQFTKKKKNRKTGEITETVDEFDVLLGKVYYRQLIVDGNKKFMLGSSSYQYNAKQLVLSDKAMQVLSKNGKVKSQDENQNLIDVYDEILEKVDQYFELYDQRHYRESLHKGRGIFVNLPLSNQYDGSKLTSYGKYETIDAILNGLHANATMSNLRYLGISSPFGKMQASNGLTIDPDSIICYQSPTGLFERQIKLSDL

SEQ ID NO: 202 - protein, 1381 aa, Lactobacillus buchneri DSM 20057
IEGIKVESNHDGEQVKYTLGLDIGTSSIGYAAIDKHQKPIRAKGKHVIGVRLFQEGKTAADRRAFRTTRRRLKRRKWRLNLLNRLFDPYLSEVDPNFLPRLKSNLSPKDDNKHFDGSTLFPDKTDAAFYRQYPTMYHLRYALMTEKRKFDIREVYLAIHHIVKYRGNFLNSATVDSFKTSNIDFTSQFDRLNELYRQVILEEPFQINMNQVDKMTNKLLDNDALKLDTQKQVAKLLPVIYNDKPVDKQYTRLATEFSKAILGYKTKLDVILNLDTQNAKDWAIRLDDEDIDDKLPALVENLDESRQEIVTIIRDLYAQITLNAIVPKGKSLSESMVDKYNDHKDHLDLLMGLIHELGDDSAKGIKLREAYTQYVGKSGDKTLNQDDFYAAIKKNLDEDSKRSPKIQRLIEQASFMPKQRTSANGVIPHQLHQLELDRIIENQGRYYPFLKEPNSNTHKPNGGKYKLDELVAFRIPYYVGPLITKQDQEKTSGADFAWMIRKPGQGGEITPWNFDQEVDRMASANTFIRRMTTKDSYLVAEDVLPDSSLIYEKFKVLNELNMLKVNDRRLSISQKQDLFNNLFKKQKTIRTKKLQTYIRTKWELPSVMISGLSDPDKFNSSLATYIDFRDVFGEKVDDPNRQADYEKIIEWSTVFEDRKIYQAKLNQLDWLTESQSKALLTKHYTGWGRLSKKLLTGLKDQNGDSILDQLWKTNDNFMQIQSRDEFAKQIHDENAKQFHEANNVDDILDDAFTSPQNKKAIRQVDKVVQDVVKAVGYAPDKIAIEFTRSPQDRPQRTFSRQRQLQSTYLNVAKALMKSNLNQELKSVIDSQQTLTDKLYLYFTQLGQDMYTGKEINFDELVNYQIDHILPQAFIKDDSLDNRVLVSAPINNAKSDNVPVKKFGAKMGYFWKQLAENHLISKRKLNNLTTDPDKIGKFTAQGFIHRQLVETSQVIRLVANILGNEYGHDGTTIIEVTAKMNHQMRKDFDLIKIRDVNDYHHAMDAYLTAYVGDYLYLRYPKLRSYFVYGDFKKLKDQSLKIRNFNFLHDLTNDEAGDKIVDQETGEIIWDKHESVKQLKKVYHYKFMLVSQEVYTRQDALFNQTIYPASDADKRKLIPIKNNKPVDVYGGYSGNVDAYMAIVRIHGKKEDKYKVVGVPMRAVADLKKAESKGRDNYLNAVHEVLKPQFTKKKKDRKTGEITEMMDDFDVLLGKVYYRQLIVDGNKKFMLGSSTYQYNAKQLVLSDKAMQVLSKDDKLKNQDENQNLIDVYDEILEKVDQYFELYDINKFRQKLHDGRKKFIELPVDNDFNGKKLISYGKRATIISILNGLHANATMSNLKYLGISSPFGMLQVPNGIILSPASRICYQSPTGLFERKVKLSDL

SEQ ID NO: 203 - protein, 1371 aa, Lactobacillus buchneri CD034
MKVNNYHIGLDIGTSSIGWVAIGKDGKPLRVKGKTAIGARLFQEGNPAADRRMFRTTRRRLSRRKWRLKLLEEIFDPYITPVDSTFFARLKQSNLSPKDSRKEFKGSMLFPDLTDMQYHKNYPTIYHLRHALMTQDKKFDIRMVYLAIHHIVKYRGNFLNSTPVDSFKASKVDFVDQFKKLNELYAAINPEESFKINLANSEDIGHQFLDPSIRKFDKKKQIPKIVPVMMNDKVTDRLNGKIASEIIHAILGYKAKLDVVLQCTPVDSKPWALKFDDEDIDAKLEKILPEMDENQQSIVAILQNLYSQVTLNQIVPNGMSLSESMIEKYNDHHDHLKLYKKLIDQLADPKKKAVLKKAYSQYVGDDGKVIEQAEFWSSVKKNLDDSELSKQIMDLIDAEKFMPKQRTSQNGVIPHQLHQRELDEIIEHQSKYYPWLVEINPNKHDLHLAKYKIEQLVAFRVPYYVGPMITPKDQAESAETVFSWMERKGTETGQITPWNFDEKVDRKASANRFIKRMTTKDTYLIGEDVLPDESLLYEKFKVLNELNMVRVNGKLLKVADKQAIFQDLFENYKHVSVKKLQNYIKAKTGLPSDPEISGLSDPEHFNNSLGTYNDFKKLFGSKVDEPDLQDDFEKIVEWSTVFEDKKILREKLNEITWLSDQQKDVLESSRYQGWGRLSKKLLTGIVNDQGERIIDKLWNTNKNFMQIQSDDDFAKRIHEANADQMQAVDVEDVLADAYTSPQNKKAIRQVVKVVDDIQKAMGGVAPKYISIEFTRSEDRNPRRTISRQRQLENTLKDTAKSLAKSINPELLSELDNAAKSKKGLTDRLYLYFTQLGKDIYTGEPINIDELNKYDIDHILPQAFIKDNSLDNRVLVLTAVNNGKSDNVPLRMFGAKMGHFWKQLAEAGLISKRKLKNLQTDPDTISKYAMHGFIRRQLVETSQVIKLVANILGDKYRNDDTKIIEITARMNHQMRDEFGFIKNREINDYHHAFDAYLTAFLGRYLYHRYIKLRPYFVYGDFKKFREDKVTMRNFNFLHDLTDDTQEKIADAETGEVIWDRENSIQQLKDVYHYKFMLISHEVYTLRGAMFNQTVYPASDAGKRKLIPVKADRPVNVYGGYSGSADAYMAIVRIHNKKGDKYRVVGVPMRALDRLDAAKNVSDADFDRALKDVLAPQLTKTKKSRKTGEITQVIEDFEIVLGKVMYRQLMIDGDKKFMLGSSTYQYNAKQLVLSDQSVKTLASKGRLDPLQESMDYNNVYTEILDKVNQYFSLYDMNKFRHKLNLGFSKFISFPNHNVLDGNTKVSSGKREILQEILNGLHANPTFGNLKDVGITTPFGQLQQPNGILLSDETKIRYQSPTGLFERTVSLKDL

SEQ ID NO: 204 - protein, 1171 aa, Lactobacillus cacaonum DSM 21116
MAKYSVGLDIGISSVGWAIIDIETKQIVNLGSRIFPSGNAAGNQERRGFRGIRRLIRRRKNRLTDLKKLLGETFFSDLKKIDSNGYEYYDIDFQINANPYELRVKGITEKLSKKELAVVLHHIIKHRGISYDLGDLEDDGTSGVSDYKNSININRQLLREKTVGQIQLERLIEFNQVHGQVKKAEDVSLLNVFPSSAYRDEANKIMIKQQEFYSEITNSFMEQVDQLVSRKRDYFIGPGNEKSRTDYGIYKSDGRTLDNLFAELIGTDKINGEKRASASSLTAQVYNLLNDLNNLHVSNTEDGKLTTSTKKEIIKAAKTTDGVFGISQICKIIGCKKEEITGFRQDKSEKKVIHTLAGYRKIRKALATINIEANELNPTVFDQIADILTLNTEKAEIRKQLDKVQLDITDEMKELVIDKNKDFLVDGRATWHSFSYQTLNMLIPELLNTSEEQMTILTRMGLMKSDNEKYRGLKKIPAEKIASEIFNPVVAKSTREAIKVFNAISKEIGKNNIEHVVIELPRDDNEEDEKRKIQKLQKANETEKEAADNLVKHKLGISDSALIAHYRKFKGLSQKVRYWYQQETYCPYCGKIIEATQLINNNDNFEVDHIIPISVSYDDSQNNKVLVHSQCNQAKEKQTPLGWINNGGGFGQSKNEYTNRVKNNKKYSKNKVDNLLNETDLTDIITQRSFIQRNLNDTRYAARTVLDEFYSFFKSNDLPTKVKVVRGKWTSQMRRKWNNVGGLRKTRDTHHHHAIDASIIASFPLLRAFDRAIKLIDVDKETGEIVQYGKASLNGDVIEEKSVIQAPIIKNEKFEKLVDEIYNFPLFKQVELANNIENPENPVKFSHHVDKKANRTVANQTIYSTRIKKTEKIVRKKVTAKEEEYVIGTIKDIYDVTNFEKFKKLYDESSKKDDIKFLMQKNDPKTWEKLVEIMNTYPDYEEISQLDGKVKRVKVSPFKLYFRENGFITKYAKHNNGPKVVSIKYYDSKLGNHIDITPVNANNKVILQSLKPWRTDVYYNNETQQYELLGLKYSDLKFTKGVYGITREAYEKLKYGYTDGVPAWKPISKESEFKFSLYRNDRVRIINEAGEKIDLLFGSRNETSEGYVEMKPIFKTNFDDAEEASFYGKTSNKRLIKKMARKGYQIYKVNTDILGNLYYTAKESNEPKLDL

SEQ ID NO: 205 - protein, 1362 aa, Lactobacillus casei str Zhang
MTKLGKPYGIGVDIGSNSIGFAAVDENSHLIRLKGKTVIGARLFEEGKAAAKRRAGRTTRRRLSRNRWRLSFLRDFFESHITPTDPNFFMRQKYSEISPKDKARYKYEKRLFNDRTDAEFYQQYSTMYHLRNRLMTDPSRADVREIYFAIHHILKSRGHFLTPGDAKDFNTNDVALDEIFPALQDAYAQVYPDLGITFDEDKANEFKTILLNEIATSIDTQRALVKLLLAEEDDKDILKQQKQVLTEFAKAVVGLKTKLNLALGTEVDSSEATAWNFSLGQLDDKWAGIESAMTDEGTEILDQIRDLYRARLLNGIVPTGKTLSQAKVDDYTQHHEDLQLFKAYLKQLEDDGTAKAIRQLYDRYIDGDDAAPFLRENFVKALTKDVTAHPNTKSPELLERLAQPDFMLKQRNKANGAIPVQMQQRELDQIIKNQAVYYDWLAAPNPVEKHRKSMPYQLDELLNFRIPYYVGPLVTAKEQKAAQGGVFAWMVRKDPEGNITPYNFDEKVDREASANTFIQRMKTTDTYLIGEDVLPKQSLLYQRYEVLNELNNVRVNNEKLSIEQKQQVIRELFERHNSVTIKQFAENLRAHGDYAHIPEIRGLADEKRFLSSLSTYRQLKSLLPEAIDDPAKQADIENIIAWSTVFEDAAIFKTKLKEISWLGSEAITKLSNIRYRGWGQFSRKFLNGLTLGNGHTIIQELLLSTNNLMQILTDETLQKKMTELNADKLKTANINDAIDNAYTSPSNKKALRQVLRVVDDIKRAADGQDPSWLYVETADGGGTPGKRTRARQHQLQEIYANAAHELIDTAVRGELEDKISDKADFNDRLVLYFMQGGRDIYTGAPLNIDQLSSYDIDHILPQSLIKDNSLDNRVLVHAIINREKNATFASTIYAQKMNATWRQWHEAGLISGRKLRNLQMRPDQIDKYASGFVARQLVETRQIIKLTEQIVAAQYPDTKIIAVKAGLSHQLREELEFPKNRDVNHYHHAFDAFLAARIGTYLLKRFPNLQAFFTYGKFTKADVKKLRGFNFIRDITHAEDKIVAKDTGEVVWDKQRDVDELDRIYNFKRMLITHEVRFETADLFKQTVYGARDSKEAGGSKQLIPKKKGYPVDIYGGYFRENTAYLAVVKVTKKTETIFKVVKIATSQVAALNKARSRSTAEELSVLTELLKPKFSKVGKNGKITDTPFEVVLPRVPREQLFYNAKYGFFMVNSDTMFHNFQEIWVSRSDQKILQQIRKAKIDYPNVDQDLDNLFHNLADQIVKYFDLYSIAGFKEKISQSQNTFNDLAVDDTDQSVGKITVINELLKGAQANGMTGSLKVLKISTPFGFTQDKSGVLTKDSSIIYQSPTGLFERSVRLTDL

SEQ ID NO: 206 - protein, 1395 aa, Lactobacillus ceti DSM 22408
MSKKYQNTKYYVGLDIGTSSVGWAVTDANYELLKVNGHKTWGSRLFTEAETALERRTHRATRRRLQRRKQRLDLLDELFAEELAKVDPQFLLRLKESQYHMEDKSTDDKYVLFNDQNRTDGEFFTEYPTIYHLRSELMQGKKEDIRAVYLALHHIVKYRGHFLLPGDNYDMQGNLSELIKRLFKFIEETLFIEDLGLTDEIQSKIEEILLTKTKTRLDRQKEIVKLFNTKHQKLDDKQKKLLEAIFKLCLGLKGNMVNIFGDKGEYGIDFTDVEDKKKKVEFSADYDNNINDYVDFFGEYFELLEITKKINDTVIFSEILVDGKGFSESKVISYEKHQQDLRKLKTLLKSLDKTLGYKYGEGLYQKILLDDVKSNYVNYSGNSQKLKKCTKDEFYGFIKSKLNSVTKKEKVSEAQQKEIAQILADMEFGDYLPLQRTTDNGVIPNQLHKKELIEIIEQQTKYHDFFNDVDENGLTIKDKIISLMTFRIPYYVGPLNDYHKVADGTGHAWIEKKKDGKIYPWNFDEMVDTEATAEKFIKNLTNKCTYLKGEDVLPKESKLYSEFMLLNELNNIKIDNQKLDPKLKMKMVSELFMKKNEKITKKKIVDYLRSIGQANGNEMVSGIDREIKSDLKTIHKIQHYYQDASLEMAENIIRWNTIFNDSTSDILKDKITKAYGDVLTPGQIKGLSNLACKDWGKLSEKFLTGIRCDVGEFKNISIIQAMRDTNNNLMELLSNKYEFMDKIQEYNKEYYGDFTFKAEPSIMDDLYVGPGPKRAIWQAVRIVEEIKRIMGHDPEKIFLETTRTNRAPKVKNTKRYDALEKKYESVKEHEYAEVKKEFEIEKNDSLNIKKLFLYFTQLGHCMYSDEKIPYNELFTNRYDIDHIYPRSKTRDNSMDNLVLVKAECNRDKKDNYPIKLKTNIQQKCQVRWAYLRDKKLITEEKYNRLVRKTPLTEDELSQFIARQLVFTSQSVKATAEVFKRLYEDSKICYVKAENVSDFRYGSTRKMSKDDQPQPFIKNRDVNDFHHAKDAYLNIVVGNVYDVKFTQNPTRFIKANKDYSLNYIFRYPVNKKGENVWDPEQSMKIVEKTLKSNDVRVTKLVKPITSPISNETLHKALKCKPGSYLPRKSSKGTPLADVTKYGGYEKIKNAYYSIYKYTYMKKKECMEEFLLVPIPIHLVNNDEELPKYINDKIAERAKKKKLETVECIVKELYQGTLVRINGYDYRIAGSSGKQFELHNGINLIVEPWVEKVLKETDKFVRKSNSKLDKKQQKENTTETLIEKQLNDVFEYLCRKLNQGIFKNNKHTLPAKLLGDSIQKRFEDASIEDEFEVIKELISAIAKNPQNFKTIQKVLDISGSSIPRFNLKLTKNNVDEFIIKNESVTGLFTHEKVIFRK

SEQ ID NO: 207 - protein, 1354 aa, Lactobacillus coryniformis subsp coryniformis KCTC 3167
MTLHYNVGLDIGTNSVGYTIVDDNGKILQVKGKNGYGVRVFKEGATAAERRIFRTTHRRLKRRKWRLRLLQDFFEPYILPQDDGFFIRRKESNLVLNDRDEDTASLFNDRSDRDFYQAYPTIYHLRQALMTEKRQFDVREIYLAMHHIIKYRGHFLLNGTVNNFTNNKIDLHSDFEELNALLLNVIPELKFQIDLDHSTMFQTTLLNTTISRSGRQRDLVKSFYNGSDDKQLAKQQKSVATELLKAILGLKAKFHKLFNLDLLETTEWEFSFDAEDIDDKLAKLEPLMTENQQQVMDILQRIFAAITLNGIVPEGKTLSASKVDSYQKHKQDLKLLKAIAQHSDKKTATVLQTAYNEYINGIASKPLKQEDFYKRLTNAVKKSSDPQVADMLALIDQEKFLPKQRTKENGAIPHQLHQLELERIIDNQKDYYPWLAELNPNQARQKVAKYKLSELVAFRVPYYVGPLIEPEVQQATSNAHFAWMARKEAGPITPWNFDQKVDRNVSAERFIKRMTTKDTYLLAEDVLPLHSLLYQRFIVLNELNNVRVNGQKLTKKQKQAVYQDLFKRQPHVTKKQFKSYLVQTGEFAESSKIEGLANETSFNSGLTTENELRKIFGAQLDEARYQVDFEQIIEWATLFEDAKILRTKLAEITWLTTEQIEKLAGIRYRGWGRFSRKLLAGLRDQNGQQIIDLLWDTPNNFMVIVSQAAFSEAITKENEKLIDRRGAQDVITDLYTSPQNKKALRQVLAIVADVQKAMGGVPPQRIFIEFAREDEKNPRRSVERSRQLEKLYQTISNEFLINSEVRQELKEAVDQKVNFKDRLFLYFLQGGVDLYSGKRINIDQLSHYDIDHILPQSFIKDDSLDNRVLVSQKLNRSKSDSVPLSEFANYKFGPAMQAKWLQLKEAGLLSKRKYDNLTLDPTKLSKFAPLGFVNRQLVETRQVIKLAANLLASEETKVVTIKANMTHQVRKELDFPKNRNVNNYHHAFDAYLTAFVGIFLSKRYPKLKPYFTYGDFQKGNKLPDLKNFNFLYELKNKDRSIDSNTGEIIWDKQRDLAYMNKIYNFKKVTVVHEVLTKSGALYNQTLYKASEDKASGRGTKQLIRKKDNMPTELYGGYTGSTSAFMSIVRLWKKDKPYYKVVGIPTRMAAKLANQAQLLDYLTKKFTTRKLVKKTGDYKTTVERFELVVPKVGFNQLVIDGGQPFMLGSATYQYNARELFISKEAVKALNKQLSTHVDLVQVFDEILVQVNRWFPLYDTNGFREKLSHGRDRFMKLNDSFEEKSDTQIDVLNRILIGFHANAARTNLKILGLGTDLGFMTQQAGIRLTEKAILVHQSPSGLFERKVALRDLKGLR

SEQ ID NO: 208 - protein, 1119 aa, Lacotbacillus coryniformis torquens
MGYRIGLDVGITSTGYAVLKTDKNGLPYKILTLDSVIYPRAENPQTGASLAEPRRIKRGLRRRTRRTKFRKQRTQQLFIHSGLLSKPEIEQILATPQAKYSVYELRVAGLDRRLTNSELFRVLYFFIGHRGFKSNRKAELNPENEADKKQMGQLLNSIEEIRKAIAEKGYRTVGELYLKDPKYNDHKRNKGYIDGYLSTPNRQMLVDEIKQILDKQRELGNEKLTDEFYATYLLGDENRAGIFQAQRDFDEGPGAGPYAGDQIKKMVGKDIFEPTEDRAAKATYTFQYFNLLQKMTSLNYQNTTGDTWHTLNGLDRQAIIDAVFAKAEKPTKTYKPTDFGELRKLLKLPDDARFNLVNYGSLQTQKEIETVEKKTRFVDFKAYHDLVKVLPEEMWQSRQLLDHIGTALTLYSSDKRRRRYFAEELNLPAELIEKLLPLNFSKFGHLSIKSMQNIIPYLEMGQVYSEATTNTGYDFRKKQISKDTIREEITNPVVRRAVTKTIKIVEQIIRRYGKPDGINIELARELGRNFKERGDIQKRQDKNRQTNDKIAAELTELGIPVNGQNIIRYKLHKEQNGVDPYTGDQIPFERAFSEGYEVDHIIPYSISWDDSYTNKVLTSAKCNREKGNRIPMVYLANNEQRLNALTNIADNIIRNSRKRQKLLKQKLSDEELKDWKQRNINDTRFITRVLYNYFRQAIEFNPELEKKQRVLPLNGEVTSKIRSRWGFLKVREDGDLHHAIDATVIAAITPKFIQQVTKYSQHQEVKNNQALWHDAEIKDAEYAAEAQRMDADLFNKIFNGFPLPWPEFLDELLARISDNPVEMMKSRSWNTYTPIEIAKLKPVFVVRLANHKISGPAHLDTIRSAKLFDEKGIVLSRVSITKLKINKKGQVATGDGIYDPENSNNGDKVVYSAIRQALEAHNGSGELAFPDGYLEYVDHGTKKLVRKVRVAKKVSLPVRLKNKAAADNGSMVRIDVFNTGKKFVFVPIYIKDTVEQVLPNKAIARGKSLWYQITESDQFCFSLYPGDMVHIESKTGIKPKYSNKENNTSVVPIKNFYGYFDGADIATASILVRAHDSSYTARSIGIAGLLKFEKYQVDYFGRYHKVHEKKRQLFVKRDE

SEQ ID NO: 209 - protein, 866 aa, Lactobacillus crispatus FB049-03
MGATQQINNIIIDIDVQGEKMGWRNVIITQHAKLTYSMNMLIVQTKDGINQIPIEDINLVLISTSQAVITSALISKLAKNQCKVIFVDDKYQPVTETVNYYPGARDIKKLKMQFEWNERRKENLWTKIVAAKLKNQISVLKNYRIDETEVEQELYKLEVNDLSNREAAAARKYFMKLFGKDFIRRNSGVINAALDYGYSILLSSFDREIAMNGYLTYLGIHHHSVENQFNLACDLMEPFRSIVDYWVKAHENITSFTPDIKYGLVELLSLQIKFNGRNTILTNAISVYVRSCLRYLSGETDDIRIEMSLCNEVPNDAINDNVKYYLYFMQLGRDAYTGKPINIDEVSQYYDIDHILPQSFIKDDSLNNRVLVAKPINNGKSDGVPLKLFGDNLATGLGITVKQMWNNWADKGLINKAKQNNLFLDPENINKHQASGFIRKQLVETSQIIKLATTILQAEYPKTKIIVVKASSNHYLRNEFDLYKSREVNDYHHAIDAYLTTICGNLLYQAYPKLRPFFVYGQFKKFSSDPKKENEILKKTKNFDFVAKLLGSKAPNEIRSQQGKVLFEKNKIRLQLNKAYNYKYMLVSRDTTTKNQEMFGMTIYPRAERDIAKSRKLIEKRKGFSTDIYGGYTGTAAAYMAIVRINKTKSSQYKVIAVPMTKRAILNKAEKEGNYEKILKQILSPSILYNDKGKRKAGVISFDIIKGKVPYNQVVQDGNKKFLLKSAIYLCNAKQLVLSEEAMRVITGHWLDSDKQDQELLDVYDEILEKIDRYLPLFDIRDFRNKLHKGREKFLKLNAEDKFKAIIQILKGLHDNSDTGELKDIGITVPFGQLQNNSGITLSSDTILVYQSPTGLFEKRVKISSL

SEQ ID NO: 210 - protein, 1368 aa, Lactobacillus curvatus CRL 705
MSRPYNIGLDIGTSSIGWSVVDDQSKLVSVRGKYGYGVRLYDEGQTAAERRSFRTTRRRLKRRKWRLGLLREIFEPYITPIDDTFFLRQKQSNLSPKDQRKLYTQTSLFNDRTDRAFYDDYPTIYHLRYRLMTEKRQFDIREIYLAMHHIVKYRGHFLNEAPVSSFKSSEINLVAHFDRLNTIFADLFSESGFQLETDKLAEVKALLLDNQQSASNRQRQALSLIYTPSTNKAVEKQNKAIATELLKAILGLKAKFNVLTGIEAEDVKAWTLTFNAENFDEEMVKLESSLDDNAHQIIESLQELYSGVLLAGIVPENQSLSQAMITKYDDHQKHLKMLKAVREALAPGDRQRLKQAYDQYVDGQENTKAYSKEDFYGDITKALKNNPDHPIVSEIKKLIELDQFMPKQRTKDNGAIPHQLHQQELDRIIENQQQYYPWLAELNPNSKRQTVAKYKLDELVAFRVPYYVGPLITAEQQRQSSDAKFAWLIRKAEGRITPWNFDDKVDRQASANEFIKRMTTTDTYLLAEDVLPKQSLIYQRFEVLNELNGLKIDDQPITTELKQAIFTDLFMQKISVTVKNIQDYLVSEKRYASRPAITGLSDENKFNSRLSTYHDLKMIVGDAVDDVDKQADLEKCIEWSTIFEDGKIYSAKLNEIDWLTDQQRVQLAAKRYRGWGRLSAKLLTQIVNANGQRIMDLLWDTTDNFMRIVHSEDFDKLITEANQMMLAENDVQDVINDLYTSPQNKKALRQILLVVNDIQKAMKGQAPERILIEFAREDEVNSRLSVQRKRQVEQVYQNISNELLNNTEIRNELKDLSNSALSNTRLFLYFMQGGRDMYTGDSLNIDRLSTYDIDHILPQSFIKDNSLDNRVLVSQKMNRSKADQVPTDFTSVELGQKMQIQWEQMLRAGLITKKKYDNLTLNPDHISKYAMKGFINRQLVETRQVIKLATNLLMEQYGEDNIELITVKSGLTHQMRTEFDFPKNRNLNNHHHAFDAYLTAFVGLYLLKRYPKLKPYFVYGEYQKASQQDKWRNFNFLNGLKKDELVDENTEAVIWDKESGLAYLNKIYQFKKILVTRGVHENSGALFNQTLYAAKDDKASGQGGKQLIPAKQDRSTALYGGYSGKTVAYMCIVRIKNKKGDLYKVCGVETSWLAQLKQLTDEDSQKAFLEQKISPQFTKVKKQKGNIIEAVEEFEVIAPHILINQRFFDNGQELTLGSATYKHNEQELILDKTAVKLLNGALPLTQSEELAEQVYDEILDQVMHYFPLYDTNQFRAKLSTGKAAFMKLPWKSQWDGNKMVQVGQQVILDRILIGLHANAAMSDLKVLKMTTPFGMIQQSTGITLSADTQIIYQSPTGLFERRVALRDL

SEQ ID NO: 211 - protein, 1427 aa, Lactobacillus delbrueckii subsp lactis CRL 581
MAKPKDYTIGLDIGTNSVGWVVTDDQNNILRIKGKKAIGARLFAEGKVAAERRSFRTTRRRLSRRRWRIKLLEELFDKEIAKVDPSFFARLHESWISPKDKRKRYSAIVFPSPEEDKKFHESYPTIYHLRDKLMKDDQKHDIREIYIAVHQMIKARGNFLHDESVETYRSGMSSLGGRSERTILSVQTLEELNDLFAENEGTEEAKLNVASAEQINDILTGGHLNADSQKEIGNLLLPSSFPSFDDKAKEKQVKKLIKNVATNISKAWLGYKADFSTILNLANVDKDQKKIFAFALQGGDEEDKVQELESLLEQSQTDIVDRLIEIRHAIVLSEIVPVGMTLSEAMIDKYDQHKEDLITLKAVIRNTKDKKKAAKLQAIYDLYVNNRHADLAKAMKLTGIKKRSELLDPEELKKAISSLLDDSPEAVEIKQMLEEKTFLPLQRSNNNGVIPNQLHQVELDEIIKKQSKYYPFLAEKNPDESEEAQKKAPTKLDALLTFRVPYYVGPMITKEEQEAQDGHSFAWMVRRDPQDHEAITPWNFEKKVDKMASATQFIKRMTTKDTYLLGEDVLPASSLKYQLFTVLNELNNLRVNGKKLTSDEKEQVIEGLFKKQKTVKADKFVKYWQAKHIGADIKVKGLSDPSKFNSTMSTYIDFKKIFGDQLNDVNRQNDFEKIIEYSTIFEDRKILEDKLRADFAWLSEEQIKQLCRLRLQGWGRLSDKLLTRLTDADGQNVLERLWNSNDNFVQIVSDPNIKAKIEQENQKLLRDGQSDDAVESILDDAYTSPQNKKAIRQVMRVVHDIVKACDGNVPAKFAIEFARSQEDDPKRTTARVNQMQKIYDQISDEVVSQGVKEQLSGMKSLKDRYYLYFMQGGRDAYTGAKLNIDRLSDYDIDHIMPQSFVKDDSLDNRVLVARAVNNQKSDKVPALLFGNKVVADLGITVREMWDKWQKLGMISKRKLSNLLTDPDALTEYRAQGFIRRQLVETSQVIKLTATILQSEFPDSKIIEVPAKYNSIVRKQFDLYKSREVNDYHHAIDAYLSTIVGNYLYQVYPNLRRMFVYGEFKKFSSNAEESAYDVVRRVKSMNFLDDLLRGTHGDNIYCRSTGEIVFNRNDIISKLKQAYSFKQMLVTQEVFTKKSALFDQTVYPSPERDSKKRSGLIPRKKGMDTEIYGGYSGNKDAYFVLAEAVKEKGHTLQIVGVPIRALNTLKNSANYSEKLLEIIKPQVMFNKDTGKPIKGIKDVKILMDKIPCRQPVLEGESYYMLASSKYRYSLKQISLSQMSMKYILDYIDDPNFNKHEMINIDQQDEKECLLSVYDEILEKMDKYLPLFDIRSFRKKLHDGRDAFIALPVASEEKKPGKVDVIRKVLKGLHANADITNLAELGFGTAALGALVSTGGIKISDDAVFIYQSPTGLFERRVKVSDLLK

SEQ ID NO: 212 - protein, 1430 aa, Lactobacillus delbrueckii jakobsenii DSM 26046
MRNKEKKKGKRKMAKPKDYTIGLDIGTNSVGWVVTDDQNNILRIKGKKAIGARLFAEGKVAAERRSFRTTRRRLSRRRWRIKLLEELFDEEIAKVDPSFFARLHESWISPKDKRKRYSAIVFPSPEEDKKFHESYPTIYHLRDKLMKDDQKHDIREIYIAVHQMIKARGNFLHDESVETYRSGMSSLGGRSERTILSVQILEELNDLFAENEGTEEVELNVASAEQINDILTGDHLNADSQKEISNLLLPSSFPSFDDKAKEKQVKKLINNVATNISKAWLGYKADFSTILNLAKVDKDQKKIFAFALQGGDEEDKVQELESLLEQSQTDIVDRLIEIRHAIVLSEIVPVGMTLSEAMIDKYDHKEDLITLKSVIRNTKDKKKAAKLQAIYDLYVNNRHADLAKAMKLTGIKKRSKLLDPEELKKAISSLLDDSPEAVEIKQRLEEKTFLPLQRSNNNGVIPNQLHQVELDEIIKKQSKYYPFLAEKNPDESEEAQKKAPTKLDALLTFRVPYYVGPMITKEEQEAQDGHSFAWMVRRDPQDHEAITPWNFEKKVDKMASATQFIKRMTTKDTYLLGEDVLPASSLKYQLFTVLNELNNLRVNGKKLTSDEKEQVIEGLFKKQKTVKADKFVKYWQAKHIGADIKVKGLSDPSKFNSTMSTYIDFKKIFGDQLNDANRQNDFEKIIEYSTIFEDRKILEDKLRADFAWLSEEQIKQLCRLRLQGWGRLSDKLLTRLTDADGQNVLERLWNSNDNFAQIVSDPNIKAKIEQENQKLLRDGQSDDAVESILDDAYTSPQNKKAIRQVMRVVHDIVKACDGNVPAKFAIEFARSQEDDPKRTTARVNQMQKIYDQISDEVVSQGVKEQLSGMKSLKDRYYLYFMQGGRDAYTGAKLNIDRLSDYDIDHIMPQSFVKDDSLDNRVLVARAVNDQKSDKVPALLFGNKVVADLGITVREMWDKWQKLGMISKRKLSNLLTDPDALTEYRAQGFIRRQLVETSQVIKLTATILQSEFPDSKIIEVPAKYNSIVRKQFDLYKSREVNDFHHAIDAYLSTIVGNYLYQVYPNLRRMFVYGEFKKFSNAEESAHDVARRVKSMNFLDDLLRGTHGDNIYCRSTGEIVFNRNDIISKLKQAYSFKQMLVTQEVFTKKSALFNQTVYPSPKRDGSKRSGLIPRKRGMDPEIYGGYAHNQDSYFVLAKIEKVKGYTLQIVGVPIRSLEIINKAEDFSTALLDIIKSKVMYNEKTGQPKRGIKNVEILVNKLPYRQPILEKDVSYMLGSSAYKYNVKQITLSRQSMKYILDYIDDPNFTKHEMTMIDEQNERECLLSVYDEILEKVDKYLPLFDGNKFREKLHSARKEFVSLSVDDEASAIEKILRGLHANSEMPSLENLKIKPALGFFQMKNGITLSNDAVLLYQSPTGLFERRVKVSDLLK

SEQ ID NO: 213 - protein, 1363 aa, Lactobacillus diolivorans DSM 14421
MRGNYHIGLDIGTSSIGWAVIDDNAKVMRAKGKTAIGARLYNEGQTAADRRLFRTTRRRLNRRKWRLKLLDEIFDPYITPVDAAFFARLKQSNLSPKDQNRDWTGSMLFPDRTDRKFHKDYPTIYHLRHKLMTEDHQFDIREIYLAIHHIVKYRGNFLNTTPVSSFSVSDVKFDEQFDRLNELYAAVSPDEPFAINGDNSKAIETLLLSDETKKFDKQKQSAKLILSETGDKALDKENTKVATQISKAILGYKTQLDVLLKYDAINSSAWKIELDDENIDDTLPGLLSQLDENRQEMVSIIQNLYAQVTLNQIVPNGMSLSESMIEKYNAHRDHLKLLKQLEDKIDDPKKKKGLEAAYDAYVGKNMKVANQDVFYASVKKNLDDSDLAKQIADLIEAQKFMPKQRTSQNGVIPHQLHQLELDQIIENQSKYYPWLTAANPNPKRIHQAKYKLDELVAFRIPYYVGPLVTPEEQEKSANQVFAWMKRKQPGTITPWNFDQKVDRMASANRFIRRMTTKDTYLIGEDVLPDASLIYERFKVLNELNLVKANYHRLAPAQKQAAYRDLFENQKSISTKKLQNYLVDQGYFTAKPKITGLSDPERFNSSLGTYIDFKEIFGDQVDNPDRQDDYEKIIEWSTVFEDRQIYEAKLRTLDWLTEDQIQALKTKRYNGWGRLSKKLLTGIVDENGERIIDVLWNTNQNFMQVQSQESFAKRIHEANAKQMKVTGVEDILADAYTSPQNKKAIRQVIRVVDDIQKAMGGVAPTSVSIEFTRSEDQNPRRTQSRESQLQNTFKVDAKEIVDSDLVTELETVSKSKKGLTDRLYLYFTQLGKDMYTGDPLNIDELSTYDIDHILPQAFIKDDSLDNRVLVSKAVNNGKSNNVPVKLFGGKMGGFWKELADHRLISKRKLKHLLTDPDTIDKYTMRGFIRRQLVETSQVIKLVAQILGDKYQNDDTKIIEVTAKMNHQMRENFKLIKNREVNDYHHAVDAYLTAFVGQYLYKRYPKLRPYFVYGNFKKFNEDHVSFRYFNFLHELMDENNKRIVEPETGEVVLEREPAIAYMKRVYHFKFMLISQEVYTRRDAMFNQTIYPAKEANRRKLIAIKHGKPVDVYGGYSGSVDAYMAIVRIHDKKGDKYKVVGVPMRALEILNATHDKKDYDAKLKQILVPKFTKVKKSRKTGEITKKVEDFEIVLGKVMYRQLVIDGDKKFMVGSSTYLYNARQLVLSDSSLDTLASKGTLDSDADSKRLVAVYDEIVEKVDKYFPLYDKNAFRSGLHKGRDKYLLLPNRSTFNGAKKVHSGKREILNEILNGLHANATLGGLKDLKISTPFGKMQGQSGIPLSSNTIICYQSPTGLFEHRVSLKDL

SEQ ID NO: 214 - protein, 1356 aa, Lactobacillus farciminis DSM 20184
MTKKEQPYNIGLDIGTSSVGWAVTNDNYDLLNIKKKNLWGVRLFEEAQTAKETRLNRSTRRRYRRRKNRINWLNEIFSEELAKTDPSFLIRLQNSWVSKKDPDRKRDKYNLFIDGPYTDKEYYREFPTIFHLRKELILNKDKADIRLIYLALHNILKYRGNFTYEHQKFNISNLNNNLSKELIELNQQLIKYDISFPDDCDWNHISDILIGRGNATQKSSNILKDFTLDKETKKLLKEVINLILGNVAHLNTIFKTSLTKDEEKLNFSGKDIESKLDDLDSILDDDQFTVLDAANRIYSTITLNEILNGESYFSMAKVNQYENHAIDLCKLRDMWHTTKNEEAVEQSRQAYDDYINKPKYGTKELYTSLKKFLKVALPTNLAKEAEEKISKGTYLVKPRNSENGVVPYQLNKIEMEKIIDNQSQYYPFLKENKEKLLSILSFRIPYYVGPLQSAEKNPFAWMERKSNGHARPWNFDEIVDREKSSNKFIRRMTVTDSYLVGEPVLPKNSLIYQRYEVLNELNNIRITENLKTNPIGSRLTVETKQRIYNELFKKYKKVTVKKLTKWLIAQGYYKNPILIGLSQKDEFNSTLTTYLDMKKIFGSSFMEDNKNYDQIEELIEWLTIFEDKQILNEKLHSSKYSYTPDQIKKISNMRYKGWGRLSKKILMDITTETNTPQLLQLSNYSILDLMWATNNNFISIMSNDKYDFKNYIENHNLNKNEDQNISDLVNDIHVSPALKRGITQSIKIVQEIVKFMGHAPKHIFIEVTRETKKSEITTSREKRIKRLQSKLLNKANDFKPQLREYLVPNKKIQEELKKHKNDLSSERIMLYFLQNGKSLYSEESLNINKLSDYQVDHILPRTYIPDDSLENKALVLAKENQRKADDLLLNSNVIDRNLERWTYMLNNNMIGLKKFKNLTRRVITDKDKLGFIHRQLVQTSQMVKGVANILDNMYKNQGTTCIQARANLSTAFRKALSGQDDTYHFKHPELVKNRNVNDFHHAQDAYLASFLGTYRLRRFPTNEMLLMNGEYNKFYGQVKELYSKKKKLPDSRKNGFIISPLVNGTTQYDRNTGEIIWNVGFRDKILKIFNYHQCNVTRKTEIKTGQFYDQTIYSPKNPKYKKLIAQKKDMDPNIYGGFSGDNKSSITIVKIDNNKIKPVAIPIRLINDLKDKKTLQNWLEENVKHKKSIQIIKNNVPIGQIIYSKKVGLLSLNSDREVANRQQLILPPEHSALLRLLQIPDEDLDQILAFYDKNILVEILQELITKMKKFYPFYKGEREFLIANIENFNQATTSEKVNSLEELITLLHANSTSAHLIFNNIEKKAFGRKTHGLTLNNTDFIYQSVTGLYETRIHIE

SEQ ID NO: 215 - protein, 1353 aa, Lactobacillus fermentum DSM 20055
MMRIKGKTAIGVRLFEEGKTAAERRTFRTTRRRLKRRKWRLHYLDEIFAPHLQEVDENFLRRLKQSNIHPEDPAKNQAFIGKLLFPDLLKKNERGYPTLIKMRDELPVEQRAHYPVTNIYKLREAMINEDRQFDLREVYLAVHHIVKYRGHFLNNASVDKFKVGRIDFDKSFNVLNEAYEELQNGEGSFTIEPSKVEKIGQLLLDTKMRKLDRQKAVAKFLEVKVADKEETKRNKQIATAISKLVLGYKADFATVAMANGNEWKIDLSSETSEDEIEKFREELSDAQNDILTEITSLFSQIMLNEIVPNGMSISESMMDRYWTHERQLAEVKEYLATQPASARKEFDQVYNKYIGQAPKEKGFDLEKGLKKILSKKENWKEIDELLKAGDFLPKQRTSANVVIPHQMHQQELDRIIEKQAKYYPWLATENPATGERDRHQAKYELDQLVSFRIPYYVGPLVTPEVQKATSGAKFAWAKRKEDGEITPWNLWDKIDRAESAEAFIKRMTVKDTYLLNEDVLPANSLLYQKYNVLNELNNVRVNGRRLSVGIKQDIYSELFKKKKTVKASDVASLVMAKTRGVNKPSVEGLSDPKKFNSNLATYLDLKSIVGDKVDDNCYQTDLENIIEWRSVFEDGEIFADKLTEVEWLTDEQRSALVKKRYKGWGRLSKKLLTGIVDENGQRIIDLMWNTDQNFMQIVNQPVFKEQIDQLNQNAITNDGMTLRERVESVLDDAYTSPQNKKAIWQVVRVVEDIVKAVGNAPKSISIEFARNEGNKGEITRSRRTQLQKLFEDQAHELVKDTSLTEELEKALDLSDRYYLYFTQGGKDMYTGDPINFDEISTKYDIDHILPQSFVKDDSLDNRVLVSRAENNKKSDRVPAKLYAAKMKPYWNQLLKQGLITQRKFENLTMDVDQNIKYRSLGFVKRQLVETRQVIKLTANILGSMYQEAGTDIIETRAGLTKQLREEFDLPKVREVNDYHHAVDAYLTTFAGQYLNRRYPKLRSFFVYGEYMKFKRGSDLKLRNFNFFHELMEGDKSQGKVVDQQTGELITTRDEVAKSFDRLLNMKYMLVSKEVHDRSDQLYGATIVTAKESGKLTSPIEIKKNRPVDLYGAYTNGTSAFMTIIKFTGNKPKYKVIGVPTTSAVGLKRVGKPGSESYNQELHRIIKSNPKVKKDFEIVVPHVSYSQLIVDGDCKFTLASDTYQHPATQLVLSKESMEIIADDFKFVKENPATADEQLVRVFDEIVNQMNHYFTIFDQRSNRQKVTKARDKFVSLPTESEYEGAKKTQVGKTEVITNLLMGLHANAAQGDLKVLGLSTFGFFQSSGGLNLSEDAMIVYQSPTGLFERRICLKDI

SEQ ID NO: 216 - protein, 1346 aa, Lactobacillus floricola DSM 23037 A
MNQTKNYDIGLDIGVGSVGWTITDSQSQKVLKVKGKQGIGVHLFNEGQTAEERRQFRTNRRRLKRRKWRLRLLRELFDEPISSIDPEFFARLKYFNESSKDPKNKGYQPQLHDDLKDVDFYRQYPTIYHLRHALMTQKEKFDIRDIYLAIHHIVKYRGHFLMNGHSSSFSVAQTDWKADLTKLFELIQETRTNLDFSFDLTEIDTIKSLLFDKNLSRNDRQKEIVGLINNNSQLDKKDKALTKQLVESVVKGIVGMKTRTDILLGYEVDNKEQSKAWNFSIDELDDQMATIDPALSQNSQAHDIITLIQKLYMTVQLAQIVPEGQSVSEMMINRYNLYAEQLQQLKDYKKINLETGLLLREAYDELMTKALTAAPGKTIHDTFYNKVKKILKDQDNKQALSIKQAIEDSNYLIPLRIKSNGVIPYQLHQRELDAIIENQKEFYPFLATPNPVDGHQEALPYKLDELIGFKVPYYVGPMVDPEVDSDQNFAWMVRKEKGEITPWNFHNKVDITQSADNFIKRMKTTDTYLIGKDVLPQNSLLYQRYTVLNELNGIKVANKKLTIEQKQRLYDQLFKKKKTVKKQDILNNLVAAGEIHEDDNLTGLSNGTTFNNNLGSYIDYCKIIGQDKLEDASKQADIERIIEWSTTFEDANIFLTKLAEINWLTEDQRQKLSQIRYRGWGQFSKTLLTDIKDNKDNSIIDNLMSTKKVFMQIINDTTIKQKIDDYNQYHLNHADLKDTIANLFTSPQNKRAINQTLLVIEDIINAVGHKPNRIFIESAKDNRNAKNQLTQSRLKRIVKQFEDNKQHVDQSVYEELKQLDDGSHASIDDRLLLYFLQNGKDMYTGQPIDISQLSTSQYHIDHILPQAKVMDNALDNRVLVSSKANTEKSDRFLSEIPQFQQRSLWAELERMGFLTKAKKERLLMTSDEFKQNSVRFIARQLVETRQIIKLVNQLIIQEHPEVKLVNIKADLTNAFRKKFNFVKNRNANDYHHAFDAYLTSLIGSHLLKSHPKWEPLFVYSDYDKIKFDNAPQGVNIMKEFEQSKLADENGEIIWNKDEMMAYLERLYNSRQILITKKVYARHGNLFKQTIFKAGESDNLIPVKNNRSDIAIYGGYKSKQVSYYALISLHNKKRQKRLVAVYLIDIQKLQNLNESDYFKTLHTIIKERHNIKPEFDILADKIYQNQLIIDNKNGSNRPFRIEGDFKNDRQLYLPLQYQRWLASKEPTDEKLNRIFDHICEQLADYFPLFAGNACDKLLDNRDKFYQLSIKSEFNDKGKLIAEGKLSVIDKLLVAMHADSRNSNLAVIGLSSSWGRFKLHGGNEAIGTSVQLIHQSPTGLFKRIQRFN

SEQ ID NO: 217 - protein, 1402 aa, Lactobacillus floricola DSM 23037 B
MTYRNYHIGLDIGTSSVGFAVRYDNGELVHKKGSNLVGARLFKEGETAEERRLNRGARRRYNRRKWRLNLLNQIFKPLIEVNDPTFFKRLEQSNLVNYDKSESFSLLNNQSDDKLHQQFPTIYHLRDYLMKSTEKADIRLIYLAVHHIVKYRGNFLDASPVDSFEASNLKVDEILTQINLLLDNLTDDLRLNTQYVTDIEQTLLSNTESNKDKEKVIQKLLLHKEAIKIDKDRTAQIAKLVLGYKADIAKLFGITEKLQTPKLELSAANSDDALMELSAELNEDQIGILLQLKTLYSRVRLNQIIPSGTSLSKSMIEKYELHHTQLKSFKENILLKLRRNTAVRRNLELAYALYVGNAQTKQEVFEPKKARFTSDDFASLKANAKSASSVKEAPKNTKTKLTTDDFYNILTELFATFESELSADEDMIKEVEQIKKAITGDNYLPKQRTDQNGNIPHQLHQIELRQILQNQLPHYPEMDKINEQKPIEKLVTFRVPYYIGPLITPEDQQKSSAANFAWMKRKEQGAITPWNFDDKVDRMQSATNFIKRMTVKDTYLINEDVLPDRSLLYQRFKVLNELNLVKVNNQLLSIGEKQAIYHDLFEKQKTVSTKKLQSYLQSEQGYGDNIEISGLSNPDKFNNGLTTYIDFKNIFGDLVEDTTKQKEFEQIIEWSTVFEDRAIFKAKLQEVNWLTEEQIKALVAKRYSGWGRLSYRLLAELVNDNGERIIDILWNNKGSNLMSIVSQDEFQQQIARINSHEVQELGMESVLANAYTSPQNKKAIRQVMKVVDDIQLAMNGQAPTSISIEFTRKPEENSEISKSRYETITSIYQSLSKDIEKEVKDNLNKNKSSLKKNLSDKYYLYFTQLGRDIYTNQPIPFNEIPYYDIDHIVPRSVEMNDSLNNRVLVAKSINQIKKNNAPIDSSLKITSETRQLWKKLLDSGLITKQKYYKLSSSIKNTVSPYVKQGFINRQLVETSQVIKLVANILGTKYQNDDTEIIEVKAHLNSEIRKTFEFYKLRELNDYHHGFDAYLTTLVGGYLYNRYPKLRSYFVYGDHKRLDKAQLSELKNFNFLHGLTNPKSGSDGLITASGSQQVVLDRNETIKRLNKIYRYKYMLISREVFTKQGQFYNETIYPAKPNTAKMIPLKDNKPSEVYGGYSSSNVSKIALIKEKNTDNYQFIGIPIRSIAKLKQAKANSKTVYQTELNRVIKSVLASQKTKKQKEFEVILDNVKYNQVVVDQGEKYYLGSPYYKKNAKQLVISPESVKILADKATADLPEQEAHNKLMTVYQEIVDVLNKHFALYDINNVRKKLNDGLIKFSQLPNYDETSKNRFDISKSIKTKYAVIMRILSGIKNQTSEVPELGLKSPLNKMQTKGGIKISPEAKIYYSSPTGIFSHFKQVKNL

SEQ ID NO: 218 - protein, 1364 aa, Lactobacillus fuchuensis DSM 14340
MNKRYNIGLDIGTNSIGWSVVNDQSQLVRIKGKLGYGVRLYDEGQTAEDRRLFRTTRRRLKRRKWRLGLLREIFEPYITPQDATFFLRQKQSNLSPKDLQKQQPQIGLFNDRLDSDFHYQYPTIYHLRYALMTEKRQFDLREIYLAMHHIVKYRGHFLNAAAASSFKSGEIDLAKDFAALNQIFGTIFSEVGFSLSESNLDEIKSILLDNNLSASVRQRKALPLIYQTAASKDSEKQYKAIATELLKAILGLKAKFNLITGIEVEDVKAWTLSFNAEDFDAKLSDLNIADNDDAVQIIEILRALYSGVLLTGIVPEGQSISQAMIDKYEAHKAHLIMLRSIREQLSDKENKALEKAYDDYIDHPEDKQHGSREDFYAAITKVLKKDSEDTNIIEILKLIELDQFMPKQRTKDNGAIPHQLHQQELDQIIENQKQYYPWLADINPNEQRQKMAPYKLDELVTFRVPYYVGPMITAEEQFQTSNKKFAWMIRKEPGAITPWNFDQKVDRQASANEFIKRMTTTDTYLLAEDVLPKQSLLYQRFEVLNELNGIKIDDQPITVEQKQAIFNDKFMQQAHVTVKNIQAYLVSEGQYASRPNITGLSDGEKFNSSLSTYHDLKKIFGDMIDDPNKQTDFEKMIEWSTIFEDGKIFADKLREINWLTDEQRQRLSNKRYRGWGQLSTKLLTKIVDQNGQRIIDILWNTNDNFMRIIHSDDFDQAVTQANQMLLADNDTQDVINELYTSPSNKKALRQILLVVADIQKAMKGQAPARILIEFAREKQANPRLSTQRRRQVEQVYQELNNDQLNKELADPQYANLSKDRLFLYFMQGGRDMYTGESLNIDRLSEYDIDHILPQAFIKDNSLDNRVLVSAKMNRSKSDHVPLDFTEERFGQKMRSQWEQMLRAGLLTRRKYNNLTLNPDSLNKYTMSGFINRQLVETRQVIKLATNLLVDQYADEDVQLVTVKSGLTHQMREDFDFPKNRNLNNYHHAFDAYLTAFVGLYLLKKYPKLAHYFVYGQYQQGFKANDQWRNFNFLNGLRQEQQVDAETGELIWQKDHDLAYMNKIYDFKKILVTREVHTNHGALYNQTLYKAKDDKASGQGGRQLIAAKENRPTAIYGGYSGKTVAYMCLVRITEKKGDFYRICGVQTAWVDELEHIEDATIKLQRLTALLTPQFSATKKQKDEVVTVVKPFEVLLPKILINQRFYDGGQELTLASATYKNNAQELVLDKKAVQVLNGQLPKAELEAQATVVYDQILERVQKYFPLYDMNSFREKLFVGRDKFNELPWQDQWENHKLIQVGQKTILDRILIGLHANAAMGDLKALNMSTPFGKLQKSNGISLSPETQIIYQSPTGLFERRVALKDL

SEQ ID NO: 219 - protein, 1129 aa, Lactobacillus futsaii JCM 17355
MADRISLGLDIGVASVGFSVLDIDKGKVIELGSRLFNATVAEGNQDRRSMRGARRLLNRNKQRRQDTGKLFQKFGLLDNFNKDNFYDTFNQNWNPYELRVKGLTEHLTKKELAESLYQIVKHRGISYALKDADADEGGTDYSASLKINSQELAEKTPAQIQLQRLNDYGKVRGQVVIGDDPDNQKVLLNVFPTSAYEKEAKQIIATQKQFYPEILTDEFTKEYCKILTRKRDYFVGPGNEKSRTDYGIYKTDGRTLDNLFEELIGHDKIYPDELRASAASYTAQLFNVLNDLNNLRILSYEDGKLTKEDKEKIIAEIKSNTTTINMLNVIKKVAGCSKEDIKGFRVNEKDKPEISSMAVYRKVHKDLLKVGVDISDWPVEFIDKLSFILTLNTENGEIRKQLNNRLVPEFDFLNDDLIQLIIDNKDSFEIKTNNKWHRFSLKTMNKLMPEMLERPVEQMTLLNEMGLVKKDKKRFENNKYLPYKEIAKDIFNPVASKSVREALKIVNAVLKKYGHIDYLVIEMPRDKNLKEEQDNIKEFQNKNKKAKDAAFEAFVKSVGSEQRVKEALSKNRKLQMKMRLWYQQQEIDPYNGETIDATDLINNPDKFEIDHIIPQSISFDDSINNKTLCFASMNQVKGQKTPYEFMLEGHGQGYDKFKATVLDNKNFDRNKRKNYLFEENVSDIETRKRFLSRNLVDTRYSSRVVLNSLQDFFHEKSADTKVTVIRGKFTSNMRKHWHIDKTRETFHHHAIDASIIAATPFLRMWKKGGTIFPVKVGEESIDIETGEILDDKKFDKVMYEEPYNGFVSEIMNADDRIKFSHQVDKKMNRKVSDATIYSTRTGKLAKDKKDAEYIVAKVKDIYSVDGFKKFKKVYDKDKSKFLLYKYDPRTFSELERIISDCPDKVEKVQTNGKVKAVDVSPFEMYRRYHGMIKKYSKKGNGPAIKQLKYLDKKLGSHIDITPANANGKHVILQSLKPWRTDVYLNHETGEYEIMGIKYSDLKFNKNVGYGIKKDKYLEIKKNEEVSEKSEFMFSLYRKDRVRIQNMKTGESVELLFWSRNFSNKKYAELKPIFKFVTEDDDWPVYGHAKTQILKRLVPKDCKIWKVNTTILGDPYYLEKESDNPKDILD

SEQ ID NO: 220 - protein, 1386 aa, Lactobacillus gasseri K7
MTKIKNEYIVGLDIGTNSCGWVAMDFQNTILRMHGKTAIGSHLFDAGNSAADRRAFRTTRRRIKRRKWRLKLLEEIFDPYMTEVDPYFFARLKESGLSPLDKRKNASSIVFPTALEDKKFYCNYPTIYHLRYDLMSEDKKFDLREIYLAIHHIVKYRGNFLYNTPVKDFEASKIDVKDSLEKLNELYERLDSEFTVELDSSNALEIEKIIRDKNVFKINKVKSIHQLLSLKTENKERTKLIKDVSKQIINAILGYKTKFETILLKNISKDEADDWEFKLTDVDADNKFENLIGDLNENEQEILLVIRNLANAITLSNIVEEGKTLSESMIDKYNKHSDDLKLLKQVISDHPDRDKAKKLALAYDLYVNNRHGKLLQAKDVLGSKKTLSKEDFYKEVKKNLDDSKASQEILDAIALDSFMPKQRTNENGVIPYQLHQLELDRIIKNQGKYYPFLKEANPVSSHLKQAPYKLDELIRFRVPYYVGPLISPNESTKNKQTKKNQNFAWMIRKEQGQITPWNFDQKVDRMASANKFIKRMTTKDTYLLGEDVLPANSLLYQKFTVLNELNNIKINGKRISVPLKQELYNNLFKKNSTVTTNKLKSYLKENYNLINVEIKGLADEKKFNSGLTTYNKLRNLKIFDQQIDDLNYDKDFERIIEWSTIFEDKAIYKDKLKTIKWLSDRQIDKLSKIRMQGWGQLSKKLLSQLTDNNGQTIIEQLWDSQNNFMQIVNQADFKDAIAVANQNLLVNTSVEDILNEAYTSPANKKAIRQVVKVVDDIVKAASGKVPKQIAIEFTRDADDKAKISQTRANKLRKVYKELSNELASEAIRNELERVAKDQKLLKDKYYLYFMQLGRDAYTGEPIDIDELEQYDIDHILPQSFIKDDSLENRVLVKKAVNNGKSDNVPVKLYGNHMAADLGITIRHMWEKWKDQGLITKTKYNNLIIDPDKINKYESSGFIHRQLVETSQIIKLASTILQSKYPDTEIIVVKARYNHYLRKHLNLYKSREVNDYHHAIDAYLSAICGNLLYQVYPYLRPFFVYGQYKKFSSDPKKEKIIYDKTRKYNFISQIFENKGNDIISLETKKKVFDKKDIIEKLKHAYDYKYMLVSRETETRDQEMFKMTVYPRLSRDTKKSRNLIPKKKDMPTEIYGGYTNNSDAYMVIARINKKKETEYRVFGVPMRELVNLRKAEKKGHYNAYLKQVLEPEIMYNKNGKKNKTISSFEIVKSKVPYKQVILDGDKKFMLGSSTYVYNAKQLTLSQDAMQAITDNCENDTDEEKALIEAYDEILTNIDKYLPLFDINKFRDKLHAGREKFINLSLDVKKDTILQVLNGLHDNAVMPKIKSLGLSTELGKLQIPTGVKLSENAKLIYQSPTGLFEKRVKISDL

SEQ ID NO: 221 - protein, 1368 aa, Lactobacillus graminis DSM 20719
MKRSYNIGLDIGTNSIGWAIVDDQSKLISVKGKYGYGVRLYDEGQTAAERRSFRTTRRRLKRRKWRLGLLREIFEPYITPIDSTFFLRQKQSNLSPKDQRKLYPQTSLFNDRPDADFYQQYPTIYHLRYQLMTEKRQFDIREIYLAMHHIVKYRGHFLNEAPVASFKSSEINLAEHFDQLNTIFADLFRESGFQLETDELVAVKALLMDNQQSASNRQRKALPKLYTPSADKSIEKQRKAIATEILKAILGLKAKFNVVTGIEAEDVKAWALTFNAENFDEELAKLESSLDDNGHEVIGILQELYSGILLAGIVPENQSLSQAMITKYEEHQAHLKMLKAVRDDLATADQQKLKKAYDQYIDGQENTKAYSKEAFYDDVTKALKDYSEQPLVSEIQKLIELDQFMPKQRTKDNGAIPHQLHQQELDRIIENQQQYYPWLAELNPNPKRQTVAKYKLDELVAFRVPYYVGPLITAEQQQQSSNAKFAWMIRKTEGRITPWNFDDKVDRQASANEFIKRMTTTDTYLLAEDVLPKQSLIYQRFEVLNELNGLKIDDQPITNELKQAIFNDLFMQKTSVSVKNIQDYLVSEKRYASRPAITGLSDEKKFNSRLSTYHDLKVIVGDAVDDVDKQADLEKCIEWSTIFEDGKIYSAKLNEITWLTEQQRGQLATKRYRGWGRLSAKLLTQIVNANGQRIMDLLWDTTDNFMRIVHFEDFDKLITEANQMVLAENDVQDVINDLYTSPQNKKALRQILLVVNDIQKAMKGQAPERILIEFARGAQKDKSLTVRRKRKLDEMYSQISDAVLADESVRQELKSSNQDDLVKEKVYLYFMQGGRDLYTGNALNIDRLSDYHVDHIIPQAYIKDDSLDNKALVSSRMNEIKADRVPLQVVQKQFGKNMASEWGYMHRAGLISRKKYDNLMFNPENLNKYQINRFISRQLVETQQVIKLVANLLSNQYEGDNVKIITVKSKLTQTIRSEFDFPKNREVNNYHHAFDAYLTAFVGMYLLKRYPKLSSYFTYGEYLKGNQQDKWSSFNFLNDLKRAKLEDKTNKEIFWHKESGLAYLNKIYQFKKILVTREVHENSGALFNQTLYAAKDDKASGQGGKQLIPAKQARPTALYGGYSGKTVAYMCIVRIKNKKGDLYKVCGVETSWLAQLKQLKDEDSQKAFLKQKISPQFTKAKKQKGTIVKVVEDFEVIAPHILINQRLFDNGQELTLGSATYKHNEQELILDKTAVKLLNGELPLAQSEELAELVYDEILDQVMHYFPLYDTNQFRAKLLAGKTAFMQLPWKSNPDDNKTVQITQPIVLKKILQGLHADAGRVSLKELGMTTDFGMLQKATGITFTPDTQIIYQSPTGLFERRVALRDL

SEQ ID NO: 222 - protein, 1362 aa, Lactobacillus hammesii DSM 16381
MNQEPYAIGLDIGTSSLGWANADMDGYIARVKGQTGLGVRLFEEGQPAADRRSFRTTRRRLSRRRWRLRLLREIFDEPISSIDPNFFARQKASSISPKDDRFETTYQLFNDKTDQEFYSKYPTIYHLRWALMTEHRKFDLREIYLAVHHIVKYRGNFLRSGNPKSFKPSELDFSQRFKEVNGLWHLIFDEVAPQLPTDNLEEITKLVLDTTRTRADRQRESVKLLMAATDNHKDWKPYLTEFTKAILGLKTKLYLLTGVDVAKADQKTWTFSLEDIEDHRADLETAFDDRSLELIEKLVDLQAAIQLTEIMPSGQYFSQSMIYRYDQHKEHLRWLKDYAEQQTDANKRKAVRLAYDHYIEGDAKGKPEIADDFYKELNRILKGDTSELAKKINHEIALEHFMPKQRTKENGVIPYQIHQQELDSIIDNQKKYYQFLGEDNPVVSHHGSQPYKIDELVSFRVPYYVGPMITADQQKKTAAGQFAWMVRKDSGDITPWNFDDKVDRTASATNFIQRMKTTDTYLIGEDVLPLQSLTYQKFMVLNELNNIRINGELLTREQKQRTYNDVFKGHGTVNVKSLIKSLECHSEVTGAIKVEGLADPKRFNSALTTYRDFKKILPVAIDQPQRQADIERIINWSTIFEDADIFKAKLQEIDWLTDTQRDRLSTKRYRGWGRLSAKLLLNIKDTQGLSIMDQLWNTQHNFMQIVHEPDYAEKIEKTNAKGLKQQDIFETINEMYTSPQNKKALRQILAVVRDIQKAHHGQAPSRIFIEAARGAEQNPQRTRQRQKQLADLFADQAKEIVNETVAQELNDETDNKARFTDRLMLYFLQNGQDMYTGEKLNIDKLSTYDIDHILPQSLVKDDSLDNRVLVSKVENLKKNDHFASELYARKMQGTWELWRSAGLISARKLKHLLMRPDEINKYATGFIRRQLVETRQVIKLVTDVLSNEYDSDKTKIISVKAGLSHQLRMELDLPKVRELNDYHHAFDAFLAVRIGTYLLKRYPKLERFFVYGQYQVAPQLDLRRFNFIHDLVSGKQEKIVAEETGEIVWNREKDVSYMKHLLSLKHLLVTHEVKEDHGALFNQTIYKAKKDNGNVGGKMKLLPTKSNRPTEIYGGHSSQAIAYLAIVRVNGKEPSYRVMGVPIRILDQLKQAKKQGEYAERLALKQFFTPDFTKGKGKIVSDFDVVIPHIPLLQPVIDEISGQSHRFALGTNTYYRNLQQLILTLADQKVLISKETGVDEEKKLVEVYSHICQQVMKFFPLYDRNKFRELLVDSRSHFEQLPIVNRYSDAGKLEIAGKRGILQQIMVGLHANATPGDLKELGVKTPFGKLQVPGGIKLTENAKLIYESPTGLFKREVKITTE

SEQ ID NO: 223 - protein, 1386 aa, Lactobacillus hominis CRBIP
MTKITEDYIVGLDIGTNSCGWVAMDSKNTILRMHGKTAIGSHLFDAGNSAADRRAFRTTRRRIKRRKWRLKLLEEIFDSHLAKVDPYFFARLKESGLSPLDTRKNVSSIIYPTSLEDKKFYVDNPTIYHLRYKLMTEDRKFDLREVYLAIHHIVKYRGNFLYNTPVKAFEASKIDVKGSLKKLNELYEGLDSEFNVELDSNNALEIENIIRDKKIFKINKVKEINQLLSLKTEDKERTKLMKDVSKQIVNAILGYKTKFETILLKDVSKDEADDWEFKLTDVDADNKFENLIGDLNENEQEILLVIRKLANAITLSNIVEEGKTLSESMKDKYKKHSDDLKLLKQVISDHPDRDKAKKLALAYDLYVNNRHGKILQAKDILEKKKTLSKEDFYKEIKKNLDDSKESQEILDAISLDSFMPKQRTNENGVIPYQLHQLELDKIIENQGKYYPFLKEVNPVSSHLKQAPYKLDELIRFRVPYYVGPLISPNESTKNKQTKKNQNFAWMIRKEQGQITPWNFDQKVDRMASANKFIKRMTTIDTYLLGEDVLPANSLLYQKFTVLNELNNVKINGKRISVPLKQELYNNLFKKNSTVTTNKLKSYLKENYKLIKVEIKGLSDEKKFNSGLTTYNKLKNLKIFDQQIDDPNYNKDFERIIEWSTIFEDKAIYKEKLKTIDWLSDRQIDKLSKIRMQGWGQLSKKLLSQLTDNNGQTIIEQLWDSQNNFMQIVNQADFKDAIAVANQNLLVDTSVEDILNEAYTSPANKKAIRQVVKVVDDIVKATSGKVPKQIAIEFTRDADDNAKISQSRANKLRKVYKEMSNELASETIRNELERVAKDQKLLKDKHYLYFMQLGRDAYTGELIDIDNLEQYDIDHVLPQSFIKDDSLENRVLVKKAVNNGKSDNVPVKLYGNRMATDLGMTIRHMWEKWKEQGLITKTKYNNLIIDPDKINKYESSGFIHRQLVETSQIIKLVSTILQSKYPDTEIIVVKARYNHYLRKRLNLYKSREVNDYHHAIDAYLSAICGNLLYQVYPYLRPFFVYGQYKKFSSEPEKEKIIYDKTRRYNFISQIFENKDNDIISRETKKKVFDKKDIIEKLKRAYNYKYMLVSRETETHDQEMFKMTVYPRLSRDTKKSRNLIPKKKDMPTEIYGGYTNNSDAYMIIARINKKKGPEYRVFGVPMRELVNLRKAEKNGHYKAYLKQVLEPEIMYSKNGKKNKTISSFEIVKAKVPYKQVILDGDKKFMLASSTYVQNAKQLTLSQYSMQAITDNCENDTEEEKALVEAYDEILTNIDKYLPLFDINKFREKLHAGREKFVDLPLAEKKETILQVLNGLHDNAVMPKIKSLGLSTPLGFMQFHTGVSLSENAKLIYQSPTGLFEKRLKISDL

SEQ ID NO: 224 - protein, 1371 aa, Lactobacillus hordei DSM 19519 A
LLYRGRYSVENNRYNVGLDIGTSSIGFAVTDEQDELVQVKGKNYIGVRLFKEGQTASERRSFRTTRRRLKRRKWRLGLLEEIFAPYLAQGDPYFLARMKESNISPRDERKKYYGSLLFSDDTVFYDKYPTVYHLRHALMTEDRKFDIREIYLAVHHIIKYRGNFLINTLINEFSSKAVDFKKDADILNDLFEQFYISDINDSFQLNTADMNEISELLLDNSKTRLDRQRESLKKLAKKVDDISVAKKHQKIATEFSKAILGNKAKFDVILNVTTDSSNDWSFKLEDEDADEKIVVLLEELNTPQQEALNIIHQWYSQISLNGIVPDGKSISEAMISSYELHKEHLALLKQQINNTKDKKKAHGLHEAYNEYVHGNNNKKLNQADFYSKVKQNLESSLITDEILELINAENFMPKQRTSANGVIPHQLHQQELDRIIQNQAKYYPFLAETNPNEKRSKVAKYKLDELVAFRVPYYVGPLITATDQKKTSGKEFAWMVRKQPGRITPWNFDEKVNKMESANTFIRRMTTKDSYLIAEDVLPDESLLYQKFKVLNELNNLRADGRKLKVSVKQKVFKELFQQQKTITIVKLQNYLKAECSFLTTPEISGLSKPEHFVSSLATYIDLKKIFGEDIDNPARQNDFERMIEWATIFEDKNIYSEKLNEIKWLNDRQKKELKNKNYHGWGKLSAKLLKGLRDSDECSIIEHMWNTQQNFMQVQAEEDFAQRIQEENNQHLKGNTLEEVLADAYTSPQNKKAIRQVVKVIEDIQKAMGGIAPQKISIEFTRAPEEKPRRSVERQQQIEKIYKSVANEVENAGVKDELQRFSDRKQTLTDKYFLYFTQLGKDMYTGKSINIDQIGNYQIDHILPQAFIKDDSLDNRVLVSAAVNNGKSDNVPTKNDRYKVREHGQRLYDQGLISKRKFNNLITDPDSINKFTARGFVKRQLVETSQVIRLVAEFLYNKYQSKSEIIEVRAKMNSQLRKDFGLIKNRNVNDYHHALDAYLTTFIGNYLYRRYPKLRAYFTYGCFKKVDDSQLKYFNFLHDIEDDKKKIIKDNDTGEILWHRDEGIARFKRIYNFKYMLVTHEVLTRQGAMFKQTVYSAAVAGSKKLIPVKEDRPIDIYGGYTNNNDAFLAIVKVTKKKQYMVVGIPQRAVVKLNDAAKQGSKAYQKVLYNVIKPQFIKKKKDRKTGKITQKLENFEIVVSKTLYRQLIIDGDQKYMLGSSAYKYNAKQLVLSEYALEVLDRSIFEKKEYTTVDLDNVYDEILAQVDKYFSLYDKNKFRQKLHESRKIFTELPINNLFSGTKLLKSGKRETLNEILEGLHANATKKDLKSLKFSTPLGMIQYPSGIILSENAILCYQSPTGIFERRVTLKDL

SEQ ID NO: 225 - protein, 1170 aa, Lactobacillus hordei DSM 19519 B
MSKYNVGLDIGIASVGWSIVDADKKKIIDLGSRIFSSGNAAANQERRGFRGTRRLIRRRKNRLTDVINFFGEKKFIDTKVVDKNGHVHYKFSVNNTESPYELRVKGLSEILTKQELVIALYHIVKHRGISYDLGDLEDDGTSGVTDYKTSININRQLLNEKTVGQIQLERLNEFGKVRGQVEENENVTLLNVFPSAAYVKEATQILTKQREFYPEITDDFIAKFMLFITRKRDYFVGPGNEKSRTDYGIYKKDGRTLDNLFDELIGIDKINGEKRASASSLTAQIYNMLNDLNNLTVPNTEDGRLTIQTKKEILEAAKTTNGLFGIAQICKIIGCKKDDIKGFRIDKSEKKIMHTLSGYRKFRKELADVNIEANDLNINLVNKIADILTLNTEKAEIRKQLDKSNMDISNEMKEIVINKNKEFLVDGRATWHSFSYKTLNLLIPELLNTPEEQMTILTRLGLVKPNNKKYEGLKNIPARRITEEIYNPVVARATREAVNVFNAITKKVGRDNIKDVIIELPREDNEVDIKKGIVKRQKQNEVEKETADALVKQHMTISDSALIAQYRKIRGLSQKVRYWYQQDTICPYCGKKIEAVQLINNNDSFEVDHIVPISVSFDDSQNNKVLVHSQCNQAKEKQTPLGWLNNGGGFGQSKADYIARVKSNKNYAKNKIDNLLNETDLNDIATQRGFIQRNLNDTRYASRIVLNEFYSFFRSNNLSTKVKVVRGKWTSQMRKKWNGVGGLSKTRDTYHHHAIDACIIACFPLLKAFDKAIKLIDVDGETGEILQDKKAIKLAQEAEIVEKISVIKNKKFENMVNEIYNFPLFKQVELANDITNLENPVKFSHHVDKKANRAVANQTIYGTRIKEKEVTKRGKKEKIQERYTLGTIKNIYDIDGFMNFKKLYDKISKNDDVKFLMQKNDPKTWEKLIDIFNSYPDSEEVTQVDGKVKRVAVSPFKLYYRENGFITKYSKHNDGPKVVSIKYYDSKVGSHIDITPKDARNKVILQSLKPWRTDVYFNSITQQYELLGLKYSDLKFTNGVYGITRDAYEKLKHGVSEDGVTAWKPISKNSEFRFSLYRNDRVRVIDEKGDSIELLFASRTTSNEGYVELKPIYKAKFDSKEEVGFYGLVSNGRLIKKMSKGGYKLYKVNTDILGKPYYVTRESDEPKLSL

SEQ ID NO: 226 - protein, 1395 aa, Lactobacillus jensenii DSM 20557
MKEIKDYIIGLDIGTNSCGYVVTDKQNNILKLKGKTAIGARLFKEGQAAADRRSFRTTRRRLARRHWRLGLLEEIFDPEMEKIDPNFFRRLKESDYSPKDSRKQFNAIVFKSIKADKRFYKKYPTIYHLRNALMHDNQKHDLREIFMAVHHIVKYRGNFLREDSVNAFKAAKFSLRGEDGIGPVDKLNDLLKEIYSEYSPELATNNLSKIEDIIKDKNLYKQDKLKQVATLLIKEADSKDKAKLNKDIAKQVANSFMGYMFRLDTLFSLTDVDVKDYKLKFSDANIDESLDDLTSLLTDAQIEFVLELQSIYNTIVLNEIVPDGMSLSESMIKKYDDHKEDLKIFKEYIDSLSDQKKAKKLLSAYNLYVNYRKSDLVEAKNLFKNKKVGDKNFADVISNFEVFGKFVSDNLDDSELANKIKARLDLGEFLPKQRTNQNGVIPYQLHQVELTQILEKQGKYYPFLITPNPVESHRNNAPYEISELVSFRVPYYVGPLIDNQSIKDKQNKNKFAWMVRQKQGQITPWNLEEMVDTTESANQFIKRMTRKDTYLLAEDVLPKSSLVYQKFMILDELNRIKIDGKKLTSELKHDIFEKLFKKQKSINLDNLKNYLLVEGNIPGLIEGLSDGINFNNSFSTYIDYRNIFGDEIDNPNKQADFEKMIEWSTVFEDRKIFKRKLKEITWLTSEQIKQVSSKRYSGWGRLSKKLLTQITDENGVNILQRLWNEPETLTEVLANPVIKRKIVEANSSFTKAKDMKDILVEAYTSPQNKKAIRQVMRVVDDIIAAAHGKKPSQIAIEFAREDQDNPQMTKSRKAQLDQIYAKISDEFLDDAVKNELKNMKDNKPLAKDKVFLYFKQMGRDAYSGEKLSLDNLQDYDIDHIYPQSFIKDDSFDNRVLVQRAYNNGKSDNVPVLLFGNKIAAGLGITIRQMWKKWLELGLISKRKFNNLITDPEKISRNMASGFVNRQLVETSQVIKLVANILQAKLPDTEIIEVKASYNSILRKEFNLYKSREVNDYHHAIDAYLTTIVGNYLYQVYPKLRPYFVYGQFKKFGKAENQEDDPVKKIKKFNFIYQLIWGKDDAICISHTNQQVFSKKDIIDKLTTAYNFKYMNISHAVYTRNNNMFKQTLFPIIERTTAKTKSLIPKKLDRPTDIYGGYSNNNDAYLALVKVDKKRGSEYRVVGIPMRAAAMLKASKNYDEDLRKVIEPMVMFDKNGKAKRGIEGFRVLVGKMPFKQAVLDGNKKFMLTGTVDTPNLKQLVLSQQNMKYILDYIEDVDCRKHKFGDKVQNPDKCLLEVFDEIIEIVDKYFELFDSRDFREKLRNSRNKFIKLEASKKADTILAILKGLQAKSTRATIKELNISDFGRIITSSISPEAQLIYQSPTGLFERRVKVKDL

SEQ ID NO: 227 - protein, 1375 aa, Lactobacillus johnsonii DPC 6026
MTKIKDDYIVGLDIGTDSCGWVAMNSNNDILKLQGKTAIGSRLFEGGKSAAERRLFRTTHRRIKRRRWRLKLLEEFFDPYMAEVDPYFFARLKESGLSPLDKRKTVSSIVFPTSAEDKKFYDDYPTIYHLRYKLMTEDEKFDLREVYLAIHHIIKYRGNFLYNTSVKDFKASKIDVKSSIEKLNELYENLGLDLNVEFNISNTAEIEKVLKDKQIFKRDKVKKIAELFAIKTDNKEQSKRIKDISKQVANAVLGYKTRFDTIALKEISKDELSDWNFKLSDIDADSKFEALMGNLDENEQAILLTIKELFNEVTLNGIVEDGNTLSESMINKYNDHRDDLKLLKEVIENHIDRKKAKELALAYDLYVNNRHGQLLQAKKKLGKIKPRSKEDFYKVVNKNLDDSRASKEIKKKIELDSFMPKQRTNANGVIPYQLQQLELDKIIENQSKYYPFLKEINPVSSHLKEAPYKLDELIRFRVPYYVGPLISPNESTKDIQTKKNQNFAWMIRKEEGRITPWNFDQKVDRIESANKFIKRMTTKDTYLFGEDVLPANSLLYQKFTVLNELNNIRINGKRISVDLKQEIYENLFKKHTTVTVKKLENYLKENHNLVKVEIKGLADEKKFNSGLTTYNRFKNLNIFDNQIDDLKYRNDFEKIIEWSTIFEDKSIYKEKLRSIDWLNEKQINALSNIRLQGWGRLSKKLLAQLHDHNGQTIIEQLWDSQNNFMQIVTQADFKDAIAKANQNLLVATSVEDILNNAYTSPANKKAIRQVIKVVDDIVKAASGKVPKQIAIEFTRDADENPKRSQTRGSKLQKVYKDLSTELASKTIAEELNEAIKDKKLVQDKYYLYFMQLGRDAYTGEPINIDEIQKYDIDHILPQSFIKDDALDNRVLVSRAVNNGKSDNVPVKLFGNEMAANLGMTIRKMWEEWKNIGLISKTKYNNLLTDPDHINKYKSAGFIRRQLVETSQIIKLVSTILQSRYPNTEIITVKAKYNHYLREKFDLYKSREVNDYHHAIDAYLSAICGNLLYQNYPNLRPFFVYGQYKKFSSDPDKEKAIFNKTRKFSFISQLLKNKSENSKEIAKKLKRAYQFKYMLVSRETETRDQEMFKMTVYPRFSHDTVKAPRNLIPKKMGMSPDIYGGYTNNSDAYMVIVRIDKKKGTEYKILGIPTRELVNLKKAEKEDHYKSYLKEILTPRILYNKNGKRDKKITSFEIVKSKIPYKQVIQDGDKKFMLGSSTYVYNAKQLTLSTESMKAITNNFDKDSDENDALIKAYDEILDKVDKYLPLFDINKFREKLHSGREKFIKLSLEDKKDTILKVLEGLHDNAVMTKIPTIGLSTPLGFMQFPNGVILSENAKLIYQSPTGLFKKSVKISDL

SEQ ID NO: 228 - protein, 1341 aa, Lactobacillus lindneri DSM 20690
MTQKVIPYNIGLDIGTNSVGWAVTDNENKLLHIKGHNGIGVRLFKEGQSAAERCGFRTTRRRLSRRKWRLRLLNEIFADKIAKVDPSFFARLKQSNVSPKDPNKTMFGNILFDNGNLNDKSFHDEYKTIYHLRQSIIDHPEKKFDIRLIYLAMHHIIKYRGHFLNQANVQDFKGGKIDLEESFKDLNSIFENQGRDLRLVTEDANKYVKELSDNSKTRNDRQKELSKVLYIPIDKNSDKNNKKVTTEIIKAILGMKAKFDVIFGIDAENAKEWSLTFNSDDFDDKIEGLSAQMTDEAGEILLILKELYFALNLSDILNNSVTDKNAKTLSEAMINRYDDHKEQLTMLKQVIDNSDKKHAKALKAAYSAYIDGENNKKISFEDLRKRIQKNLDNSETSKKINDLLEHDYFLPKQRSKENGAIPHQLQQQELDKIIESQKHYYPFLAELNPNEKRSRQAKYKLDELVAFRVPYYVGPMVKATENNQSNNGKFAWMIKNDNISDKLKKEEITPWNFDKKVDRTETATKFITRMTTTDTYLIGEPVLPKNSLLYQKFVVLNELNNLKINKQPITPEQKQYVYEHVMKQTKRVSLKKIADALVIKGDYPYAPEITGTTDQKNMNNGLSTYIDLAKIFGDELDDIDRKEDFEKIIEWSTIFEDQHIFALKLKEIKWLTEDQRKQVVKLRYQGWGKLSKKLLADLVDDNGQRIIDLLWDSKQDFMQIVNQNSFKQAIAEHNGAHLEEKDLKDIINNLYTSPQNKKAIRQVILVVDDIIRAVGYEPVNIMMEFAREDSKDHRLTNSRSRQLEKVYKDITNSWFDDDNVKDELKDKIKDKAKFTDRLYLYFTQGGKDLYTGEPLDIDNLSNYQIDHILPQSFILDNSLDNRVLTSKINNQIKKDNLPGEFFGSKMHNFWKHLKELHLISNKKYYNLTLTPNSISKFNNQGRFINRQLVETRQVIKLAAEILHNRYSEENGTNIVTVKANLTHHMREKFNFYKNRNVNDYHHAFDAYLAAFVGNWLLQQYPKLKPYFVYGDFAKTEIDNLKSFNLIYKFEQAHQLNEEDGKIAKDTDALLGYMKNVYHFKKMLVTKELETNHGNLFKQTLYPSHGKMKNLINPKENRSSDIYGGYSSETGAYVSLIKVFKKNKIENKIIKIPLLYIDKLNRQANAKQFIRNFIIKDDSNKFDILSEKIFLNQLVIDGDELFTISGSGDRQNAQQLILSDKSLKILSKNINVISKNDLIIIFNEIIDDICKYMKMYEVENSDETKAKFEEINDKDRMLKIINDLLLGLHANASRSNLSSIGLSPSFGRFFSGNAGIKLSENAKFIYQSPTGLFSRKVKISDL

SEQ ID NO: 229 - protein, 1174 aa, Lactobacillus mali ATCC 27304
MGKYSIGLDIGISSVGWSIIDIEKKKIVDLGSRIFPSGNAAANQDRRGYRGTRRLIRRRKNRLADVINFLGEENFIDTKVVDQNGNIHYKLLVNSTESPYKLRVKGLSKMLTKQELVIALYHIVKHRGISYDLGDLEDDGTSGVTDYKTSININRQLLIKKTVGQIQLERLKEFGKVRGHVKKDENITLLNVFPSSAYVKEATQILTKQREFYPEITDDFITKFIPFISRKRDYFVGPGNEKSRTDYGIYKKDGRTLDNLFDELIGIDKISGEKRASASSVTAQIYNMLNDLNNLTVTNTEDGKLTTQTKREIIEADKTTNGLFGITQICKIIGCKKDDIKGFRIDKVEKPIMHTLSGYRRFRKELAKINIEANDLDINLVNKIADILTLNTEKAEIRKQLNKSNIDVSNEIKELIINKNKDFLVDGRATWHSFSYKTLNLLIPELMNTSEEQITILTRLGLVKSNSEKYKGLKNIPARRITEGIYNPVVAKATREAVNVFNAIAKKIGRDNISDVVIELPREDNEADIKKGIVKRQKQNELEKEAADALVKQQMTISDSALVAHYRKVRGLSQKVRYWYQQGTCCPYCGKNIEAVQLINNNDSFEVDHIIPISVSFDDSQNNKVLVHSQCNQAKGKQTPLGWLNNGGGFGQNKTEYVAKVKTNKNYSKNKMDNLLNDMDLSDIVTQRGFIQRNLNDTRYASRIVLDEFYSFFKSNNLSTKVKIVRGKWTSQMRKKWNGVGGLKKTRDTYHHHAIDASIIASFPLLKVFDKAIKLIDIDRETGEILQDKEAIKMSQEAKLLEKIPVIQNEKFEELINELYDFPLFKQVELANDITNPENPVKFSHHVDKKANRSVANQTIYGTRIKEKEINKRGKVEKVQERYILGTIKNIYDIDSFTSFKKIYDKMSKTGDVKFLMQKKDPKTWGKLVEILNSYPDSEEITQVDGKVKRVKVSPFELYRRENDFITKYAKHNDGPKIVSIKYYDSKIGSHIDITPINAKNKVVLQSLKPWRTDVYFNSETRQYELLGLKYSDLKFTNGVYGITSEAYEKLKHGISEDGTKTWKPIGKNSGFRFSLYRNNRVKIVDEKGESLELLFASRTTSNEGYVELKPIYKSKFDSKEDVGFYGQMTPSGQFVKKMARVGYKLYKVNTDVLGNPYYITKESDDPELSLYKK

SEQ ID NO: 230 - protein, 1357 aa, Lactobacillus mindensis DSM 14500
MNDRNKKYNIGLDIGTGSVGWAVTDNNYNLLHAKKKNLWGIRLFDGAETAASRRTFRSTRRRYRRRRNRINWLNEIFADELAKKDQSFLVRMNSSWVSKKDKIRQRDQYNLFMDSDYTDVEYHREFPTIFHLRKRLIEDKSQADIRLVYLALHNIIKYRGNFTYEHQNFDVSHMDSGLALLLNQLNQQLQAFEVAFPDETNFESMSTILLEKKTPTQKIDEIVDQIQPEKDLLQITKNIMKMLLGNKADLVKIFSLDSDDKITVEFSSNSIEQDLSNLEETLSDEQFNIITLANSIYSSIVLNDILSGETYLSFAKARQYSDHKKDLAKLKTMWRESPDRKAVGKAKKAYDDYLHSGKYGIEDFYKDMSKFLETATPVELAKEANEKILNKSYLLKQRNNENGVIPFQLNKNEMIEIINNQAKYYPFLAENKDKLLSILSFRIPYYVGPLQSKKDNPFAWMEKKSQGKIRPWNFDEIVDREASSNNFIRRMTSTDTYLIGEPVLPLKSPIYQKYEVLNELSNVRINADEVDNPLGDKLSVDLKQAIYNELFLKHRSVSKALLTKWLINQSYFQNPQISGLADSKKFNSGLTTYHDFKKIFGEDFVNDPTNQSQLEQLAEWLTIFEDKKILKIKLDDSQFNCTPEQIKKIAGMRYQGWGRLSKKLLCDIKTTTVTSKNHQQASYSILDLMWNTNRNFISVLKNDTYKFEDKIQTFNLDKNEAATPQAMIDELQTSPALKRGIRQSVTIIQELVKFMGHAPEHIFLEFTREDDVSSLTKSRDSRLNKLYARIAKNTKKTDDELKKSLLPSSDIKATLKANKNNLSNDRLMLYYLQMGKSLYSNQPLDINRLSEYQIDHILPQSYIKDNSLENRALVLASENQHKSSDLLLKPEIINQNIARWRYMKDAGLMGPKKFKNLTRIQITDSDQNNFINRQLVQTSQIIKHVSNILDSMYGDQGTQCVETRAHLSTEFRKAFSNEDDNYHFQHPEFVKNRNINDYHHAQDAYLACLLGLYQMKKYPTDNMILLKKEYKRFFSNTKKIYDKKHHFPDYVKNGWIIGSMFNGEKYVDEETGQIIWDQQTKDMVSCIFQYKQYNVTKRTEAANGEFYNQTVYKKDPNEKRKLISLKQGLDTKLYGGYSGDNPAYIVLVKIDDKKNKLVKMPIRLAEQVDNKTIDLQTWLEENVPHKKGIQVLKTKIPLGQVIYSKKNGYLALKSDTEIVNAQQLVLPYGYVALLTLLQKMPENKYDEVLACYDDGILDNIFVAIIDKMKHFYPYYSGELKTLSDNIDNFKESPDVNKIKTLQQLLLLLHASSTTASIEFNNVKKNSLGRKPNSINIQNTDLLSFSATGLYESRIHID

SEQ ID NO: 231 - protein, 1382 aa, Lactobacillus mucosae DSM 13345
MDIGTNSIGWTAIDDHFSLLRVKGKNAIGVRTFKEGETAADRRGFRTARRRLSRRRWRLQFLDEFFAPYLAEVDPNFLARLKQSDISAKDPAKNQEYMGKLLFPDQEAASDGNGYPTLIQMRKAMPAEKAADFPVFNIYQLRYALMNEKRKFDLREIYLAVHHIVKYRGNFLNNTSVDKFKADQIDFNKSFETLNDLFRQVQPIAPFQIDLTKVDELGKLLLDTKQKKLDRQKAVAKLLPLIEDGTDKEIVKAHQQTAREISKLILGYKAKVGLILQNNLDQTLDMSTENSDDQLMQIAEELDDYQMELINQLSLLYSQIMLNEIVPNGETVSASMLNRYYKHRCQLKELKDYGAAQDKKTREQLDHLYAEYIGQIPKDSKFDFTKDLKKLMDKSDLGQKIKDEIEAGDYLPKQRTSANGVIPHQMHQQELDQIIENQKEYYPWLAEPNPVEKNIKNAKYKLDQLVSFRVPYYVGPMITLADQQKTSKASFAWAVRKKAGKITPWNFYDMIDREKSANNFIKRMTNKDTYLLSEDVLPASSLLYQKFTVLNELNNIRVNGRKLQPALKQAIYTDLFQKRKTVNLKTLTNFLAIHEPTLTKPKIEGLSNGRSFNSSLGTYIDMSKILGDSLDDLNYRDDIEKIIEWSTVFEDSEIYGVKLQEIQWLTNEQREKLVRKRYQGWGRLSKKLLTGITDENGQRIIDLMWDTSKNFMQIVHQPVFEEQIAELNQQLLQDADKAPLEVVDDILADAYTSPQNKKAIRQVVKVVADVVKAVGNAPASISIEFARNEDRNKELKNSRRHSIEKLYHETAEKLVKQTNLLEELGNVKDLNDRYYLYFTQAGRDMYDGTPINIDEISTHYEIDHILPQSFLKDNSLDNRVLVKKSENAAKSDRVPAKLYGAKMRAFWKQLKESQLISNRKYLNLTTDPEQVDKYQMQGFVHRQLVETRQIIKLAANIFGSLYPDSAVIETRAELTKQLREKFSLYKVRDVNDYHHAVDAYLTAFAGHYLYQRYPKLRPMFVYGDYAKIYADDLKRLRSVNLFHDLEKDQYNSGTAVNPETKEKIVDVDWLSDYVSKIQHFKYMLISKAVYTQHGQLYGATILPVAQVDKISAPIGIKDDKPVDIYGAYTNEVAAYMAIVRVNGKKPKYKVVSVPVRMLQRLKMAEQKGHDQYMQTLHDVLLRNFTSLKKNRKTGLKEAVVKDFDVLVPCVRYNQLVIDGDTKFTLGSATYQHNAKQLVLCNHSLETLANNFEYVRKHPDEADERMIMLYDDILDQVNHYFTLYDKNKFREKLNAGRDKYLKLPTFSQFENNKKTAIGKSEAIINILRGLHANAAITNLKCLGVSTPFGQLQSPSGIELSENAKLVYQSPTGLFSREVLLKDL

SEQ ID NO: 232 - protein, 1376 aa, Lactobacillus namurensis DSM 19117
MDKKYGIGLDIGTSSIGWTVVDKYGHIIRVKGQTGIGVRLFREGQTAAERRTFRTTRRRLSRRRWRLRLLREIFDEPISAIDENFFARQKASSLAPGDARYQQAFQLFNDRTDQAFYCKYPTIYHLRQALMTESRQFDIREIYLALHQIIKYRGHFLLGGAAKDFQSDKLDLEAYFTTINAQLAGIYSDGSVQLPTLDWNQACQELTDTSRTQSDRKNWLVKELKSYGDSQLKPIYTQIANAILGFKTDLAKIMGINDPEKALSFNLDALDDHRDDVAELLTDEQIPLVNLLAKLHTALELAAILPDGQTLSGKMVEIYETHRKQLKTYKAFIRQLPDRQQRLALKQAYDHYIDQGLNREAFYSEVKAILEKQKPLTATGQAMKKAMDQNAFLLKQRTKTNIAIPYQVQQQEMDQIIANQSKYYPWLATPNPVKSRRVIAPYKLDELVCFRVNYYVGPLVQSKPGEATKEAKFAWMTRKDPQSTVAITPWNFDQQVDRQASANAFIQRMKTTDTYLLGEDVIPKNSLLYQKYEVLNELNNVRVNGDWLDPQRKQYLFKKLFMDQPQSVVTVKALQKTLVVIGACPTLPTVEGLANPKRFLSQLTTYHDFCKLLPDDIQRADRQADIEKIINWSTIFEDTAIFKEKLRDIKWLSADQIRRLSSRPRYRGWGRFSAKLLCGLHDRQGNTVMDELWQTSRNFMQIIRQSDFQTAIAAVNQQDLGRQDLQRVIDDLYTSPQNKKAIRQVLAVVTDIQKAMHGKAPSWLFVEVAKGAQKNPQRTQSRQSKLAEAYRESARELVDEAVKEQLLTLPDDRQTFSDRLVLYFQQNGRDIYTGEPLDFERLSNYHIDHIIPQAVVKDDSLDNRVLTSNQANLEKGAHVPTIFRDKQEPVWQELYRVGLISHRKLRNLLTTPDDLDDRGRATGFIARQLVETRQVIKLVMEVLSQYYDTTETELISIKAGLSHQFRQELNLPKLRALNDYHHAQDAYLAARIGTYLLQRYPNLKRFFVYGDFKKTHFDLQRRFNFIGGMISREKQPYNLIKNPVTHQVIWDEEMEIGDCQKKNPEQPKHDATVKMMNLTKIMNLKHILVTHEVYENHGALFNQTIYPASQAHKKKLIPQKTEKPIELYGGHSSEQAGYMAIIRLLGKRPGYKVMRVPVRYVSQLQHQDVAEQKKLLYKIFVSELTSRNKVKPFEVVVPHVCLNQPVEDMIKGQWHRFALRTNGYYQNQQQLILSLVAQRTLAGYKPKDDELMAVYHEICKQVKYYFPLYKMNKFQSRLFAAEELLQKRSTVNSFSITIGKNGKENKTLNLGKRELLLRLLGGLHANATRVDLKDIGCTGQFGQLQVKNGIKLTEQAVLIHESPTGLFHRRVRLNDL

SEQ ID NO: 233 - protein, 1137 aa, Lactobacillus nantensis DSM 16982
FYFKIRLSEVVIMADRISLGLDIGVASVGFSVLNIDQGKVVELGARLFNAKVAEGNQDRRSMRGSRRLLNRKKQRRQDTAKLFEEFGLISNYDKDNFSEFFDNNENPYELRVKGLTEKLTKNELAESLYQIVKRRGISYDLKDADFEDGGTDYSSSLSLNNKALEDKTPAEIQLQRLNEFGAVRGKVVVGDDLDNQKVLLNVFPTKEYKKEAQRIIATQREFYPDILTDEFEKQYCSILTRKRDYFVGPGNEKSRTDYGIYKTEGRTLDNLFEELIGHDKVYPDELRASAASYTAQLFNVLNDLNNLRILSYEDEKLTQADKETIINELKSNVTTVNMMNLIKKVSGCEKDDIKGYRTNDKDKPEISSMAIYRKTHKEFLKADVDITQPIEFINELSFILTLNTENGEIRKQIVKKLKPHYDFVDDNLIQKIIDHKDSFEISTNNKWHRFSIKTMSQLIPIMMERPIEQMTLLNELGLVKKDSKRFANNKYLPYREIANDIYNPVAAKAVREALKIVNASLKKYGHIDYLVVEMPRDKNLDEEKKQIEDFQKKNKIAKDEAYRAFVTAVGDEKTVKIALSKSRKLQMEMRLWYQQNEIDPYNGETIEAVDLIRNPDKFEIDHIIPQSISFDDGINNKTLCFASMNQVKGQKTPMEFLNEGHGQGWAKFKAMVSGNPRFGKSKKQNYLFAENVSDIETRKRFISRNLVDTRYSSRVVLNSLQEFFSEKSDGTKVTVIRGKFTSNMRKHWHIDKTRETFHHHAIDASIIAATPFLNMWKKGGSIFPVKVGEESIDIDTGEILDDKKFDKIMYEQPYNGFVTEIMNADDRIKFSHQVDKKMNRKVSDATIYSTRIGQLVKDKKVAEYVVAKVKDIYSVDGYKKFRKVYDKDKTKFLLYTHDERSFSELEKVLYMYPDKIDQTQNNGKVKSIDISPFELYRRDHGMVKKFSKKNRGPVIKQLKYLDKKLGSHIDITPANANDKHVVLQSLNPWRTDVYLNHEIGEYEIMGIKYADLKFNKNGEYGIKRDKYIEIKEREKVSKNSEFMFTLYKKDRIKVENMDNKENIELLFWSRNMSNNGYAELRPISKTVNDGTIPIYGKGRLIKRLIPKNCKIWKVNTNILGDPYYVEKESENPKDILD

SEQ ID NO: 234 - protein, 1132 aa, Lactobacillus nodensis DSM 19682 A
RNLENKISLGLDIGVASVGFSVIDAQEGKVLELGARLFNSSVSAENQTRRDMRGSRRLSNRKKQRRKDVAQLFKTFGLINYFDKENYFDNFQNNLNSYELRVKGLSEKLSKEELVNSLYHIVKRRGISYDLADADTDFDGSDYSSSLNQNQLELQTKTPAEIQLTRLNVHGAVRGKVTINGEDEDTMQVLLNVFPTKSFVSEAKKIIQTQQQYYPDILTDIFETKYLEILERKREYFVGPGSEKSRTDFGIYKKDGRTLDNLFEELIGHDKIYPDELRASGASYTAQVFNVLNDLNNLRISSYENGKISTEDKIKIVEDLRNNIGNVIIMKIIKKVAGCEDDDIKGYRLDSKDKPDIHSMAVYRKVHRDLLKYDVDIIKWPTEFIDELSPILTLNTENGEIRKQMVNKLQPKYSFLTDELIQVIINNKSSFDVTSNNKWHRFSLKTMNVLIEEMFRRPVEQMTLIQELGLIKDSGKRFENCKLLPYREISKDIFNPVASKSVREALKIVNAVMKKYGQIDYLVIEMPRDKNEEEMKKQIEKFQKENNKQKDEAINEFVKKIGNKNAVDDGLRRYGGKLYFKIRLWYQQDGIDLYNGKVIEPFDLLNNINKFEVDHIIPESISFDDSINNKTLCYADMNQIKGQKTPFEFMNEGHGQGFAKMKAMVNKNSKLKGKRKNYLFDENISDIETRKRFISRNLVDTQYSSRVVLNSLQEFFKEKETGTKVTVVRGKFTSNLRKHWHINKTRDTFHHHAIDASIIAATPFLRIWKKDASLFPMHVSENTVDIETGEILNDTEFKKDFYGLPYSSFIEELNGADDRIKFSHQVDRKMNRKVSDATIYSTRKGMLNKDKEETDYVLGKIKNIYDVSEYNKFKRIYDKDPNKFLLAHHDPKSFDELRKIMQEYPSKIDKVMTNGKVKSVDISPFELYRRKHGMVQKYSNKNKGPVIKQLKYLDKKLGSHIDITPKDTLNDRHVVLQSLKPWRTDVYYNSVTGEYEIMGIKYSDLKFNGGEYGIKMSKYLEIKEREQVSDESEFLFTLYKRDRIQIINCENDEIVEMLFWSRNNSNIGYAELKPVYKYKTEDESWPVYGYGKNQILKRLVPKNCKILKVNTDILGNPYYIKKESKNPKNILD

SEQ ID NO: 235 - protein, 899 aa, Lactobacillus nodensis DSM 19682 B
MNRKTTKFNIGLDIGTGSVGWAVTDDNYNLLHAKKKNLWGVRLFNTAETAADRRLNRSARRRYRRRRNRLNWLDEIFADELFQADPGFLNRMKHSWVSKKDTARTRDEYNLFIDKEFNDKTYFDKYPTIFHLRKHLIEDTQKADIRLVYLAIHNILKYRGNFTYEHQNFDVSKMNEGLENTLSNLNNSLDLFGLKLPDDADFKKISEILLEKDWSPSSKVSSIITLLKPEKDMKQLYKQIFTLLVGNKADLTKLFNIDSAEKITISFSSNTIEADLSDAQEKLTDEQYAIVEMANPIYSTIVLNEILNGETYLSFAQVTKYENHHEDLMKLKDLWRNDSDRKAVKKARLAYDKYLDDGKYNLDDFYKDLKKYLSTKEDPYSQSALEKMENHQYLLKQRTSDNGVIPFQLNENELVKIIDNQSQYYPFLKENKDKILSLINFRIPYYVGPLQSEDKSDFAWMERKANGPIRPWNFDEKVDREKSSNNFIRRMTATDTYLIGEPVLPKYSLIYQRYEVLSELNNVRIKSTGEESDKGSRLNVDVKQRIYNELFKKHTTISTKRLTDWLRKESYYSAPEIHGLADKTKFLSSLSSYRKLAKIFGNDFVDDSKNLKQLEEVIEWQTVFEDRQILKLKLKNSKLYTDDQIKQLAAIRYQGWGRFSNKLLTQLLVETKVNGEHMPSNHSILDLMWQTKSNFMEIIREDKYNFEKQIKDYNVGDAADKKPLDLVNELPGSPALKRGIWQAIVIVQELSKFMKHAPEHIFIEFTREDQDSGITKSRYNQLDKKYKNIGDMVRNLAPKLKNTLYLKAQLKDKKDALSNERLCCTSYKWVKAYTVKPRLISTVYSRQIIKLITSCHSHISRTIHLKIRLWSKQVKTKENSMTYSYQTMSLPTTFNVGNN

SEQ ID NO: 236 - protein, 1357 aa, Lactobacillus oligofermentans DSM 15707
MAAKNYNIGLDIGTSSIGWAIVDDNYQLMHAKGKYGYGTRIYSEGQTAADRRGFRTTRRRLNRRKWRLRLLQDFFEPYILPQDEAFFIRQKQSNLVPQDTKKQYPESVLFDDTSDKDFYTEYPTIYHLRQALMTENRQFDIREVYLAIHHIVKYRGHFLNNAPVKTFKSGNLDLAIKFNELNEEFKSVYPDLELQFNLDQIDEIKKILLDSTKSRFDRQGEAVKLIYTVSEVKTIEKLQNKIVKQFLSGILGLNTRFDVLTNTESDDSMWKFSLDSESSDDALDEIIAQLDDPAIHVVELVNEIHSSITLAGIVPEGQGLSESMVEKYEAHKAHLQLLKAVEKLVDKKAADKLEVAYDQYINGKDSKQFIKEDFYKAVQSEIKGVAGDEVAEINQLIELDQFMPKQRTKENGAIPHQLHQHELDVIIENQSKYYDWLGEKVGNEYKLDKLVSFRVPYYVGPLVDTASKEKKDETRFAWMVRKNPESTEAITPWNFEDIVDKNASAENFIKRMTTKDKYLLNEDVLPKCSLLTQDFEVYNELNNIRVNGEKFTAEQKQLIHDELFTKHASVSIKQLKDFLVSELMYVRDNLKVEGLADEKKLMSSLSTQFDYQKIIPDQINDVKYREDIEQIIEWSTIFEDAAIFKTKLKEIDWLTDEQRNKLANKRYRGWGSLSKRLLACLVDENGQRIIDILRDSSDNFMMIVNRPEFKQAIFDENANLTETNSKKDMFEMIDNFYTSPQNKKAIRQVLLVVQDIQNAMGGVAPQKIFIEFAREDEVNGRRTNSRYSQIREMYSKVTDDVINKTVRGELEANKGSLNKEKLFLYFLQGGIDLYSGKTINIDNISSYDVDHVLPQSFIKDDSINNKVLVNAKGNRVKNDNVPMELFGAKMYPTWKRMVDTGIMSKAKFKNLTLNPDNVDKFKAEGFINRQLVETRQIIKLVAQILNDKLGDDTKIVSVKANLTHDMRVFFDFPKNRNVNNYHHAFDAYLSAFVGTYLYKRYPKLQPYFVYGEFKKMDKLKNMTSFDFLRDLKHTDKVVDKDTGEIIADKLAVITNMNKIYDFKKVLVTHEVHENSGAMYDQTLYPAKLDKSLGRKGAKQLIPKKDDMPTALYGGYTGSKDAFMSIVRLKKKDEVYYKVIGIPVRIADSVQHGKEVDVEALTQFIETKFTKENLNKKTGEITRKVEWFELVLPKVLFGQAVFDGGQPFMLGSSTYPHNLRELVLTKDSVKKIAGKESNKSYLDAYDEIMEAMNKYFPLYDTNKFREKVIEGRSKFIDLPDKDEYENNKLVQVGKSTIIDRMFIGLHANAARTDLKNIGITTPFGFMQQASGIKLTKDTVVLFQSSTGLFERKVALKDL

SEQ ID NO: 237 - protein, 1395 aa, Lactobacillus otakiensis DSM 19908
MVISSCIIGDVPKGVTGQHYFEEFYRMKVNNYHIGLDIGTSSIGWVAMGEDGKPLRVKGKTAIGARLFQEGNPAADRRMFRTTRRRLNRRKWRLKLLDEIFDPYITPVDSTFFARLKQSNLSPKDSRKEFKGSMLFPDLTDKQYHLDYPTIYHLRHALMTQDKQFDIRMVYLAIHHIVKYRGNFLNSTPVDSFKASKVNFDDQFKKLNELYTAINPEESFQINLANSEKIGQQFLDPSIRKFDKKKQIPKIVPVTMDDKAVDKLNGKIASEIINAILGYKSKLDVAVQCDPEDSNPWAVKFDDEDIDAKLQKILPEMDENQQSIIGIIQDLYSQVTLNQIVPNGMSLSESMIKKYNDHHDHLKLYKKLIGQISDSKKKTALKKAYDQYVGNDGKVIEQDDFYSSVKKNLDDSELSKQIMDLIDADKFMPKQRTSQNGVIPHQLHQRELDEIIEHQSKYYPWLAESNPNKHDLHLAKYKIEELVAFRIPYYVGPMITPEDQKKSGAAVFSWMKRKEPGQITPWNFDEKVDRMESANKFIKRMTTKDTYLIGEDVLPDESLLYEKFKVLNELNMVRVNGDSLKVADKQAIYQDLFENYKHISVKKLQNYIKGKTGLPNNPEISGLSDPDQFNNSLGTYNDFKKLFGDKVDDPDLQNDFEKIVEWSTVFEDKKILRAKLNEITWLTDKQKDDLESSRYQGWGRLSKKLLTGIVNDQGERIIDELWNTNKNFMQIQSDDDFAKRIHEANADQMKSTNMEDVLADAYTSPQNKKAIRQVVKVVDDIQKAMGGVAPKFISIEFTRSEDRNPRRTISRQRQLENTLKDTAKSLVKSMNPNILSELDNASRSKKGLTDRLYLYFTQLGKDMYTGEPINIDEISNYDIDHILPQAFIKDDSLSNRVLVSKAVNNGKSANVPLKLFGAKMGHFWKQLAEAGLINKHKLKNLQTNPDTISKFAMHGFIRRQLVETSQVIKLVANILGDKYRNDDTKIIEITARMNHQMRDEFGFIKNREINDYHHAFDAYLTAFLGRYLYHRYIKLRPYFVYGDFKKFREDKVTMRNFNFLHDLTDDTQARIADTETGEVIWDRETSIKQLRDVYHYKFMLISQEVYTLRGAMFNQTIYPASQAGRKKLIPMKADKPVDVYGGYSGSTDAYMAIVRIHDKKGDKYKVVGVPMRALNRLNTAKNVSDAKYDQELKEVLTPQFTKSKKNRKTGEITQTVEDFEVVLGKVMYRQLVIDGDKKFMLGSSTYQYNAKQLVLSDESIKTLASEGKLNEAQESAAYDKVYDEILDKVNKYFALYDTNKFRQKLSLGKDKFVGLPNHNVFDGSKKISSGKREILNEILNGLHANATLGTLSDIGFSTPFGKMQQPRGIGLSSNTSIEYESFTGLFKRTIFLKDL

SEQ ID NO: 238 - protein, 1078 aa, Lactobacillus ozensis DSM 23829
MHKHYKYALGLDVGVGSVGYALLKLDEADQPCGLLKANSVTFPMSQDRTGNTLASIARNYRSGRRLNRRRKLRKQLVSNLFTKNGLINRNDVYSPYTKHPNFDLYRIWHDSFNQQISNQDLYRLLYYFAGHRAFKSNRIHQLKSSGDKDTTKLLSSIDTNKEYFNNSQYNHLGEMFYCDPKFAQRKHNKGYDDGYLFNIDRGTLLSEIKEILNAQSKFGNPAINDDFKARYLKILSQQRNFDVGPSNPSRFALVDSSGNIKLRNKKDKLNLSFKTSAKASYTFQKFQILQKLANTRYKLNSQSKYQSLNAETIDKIFNKAITKANYKYSQLKKDLKLPDSARFNMVMYETSDDKSAKQAETKTFIIKDNTYYILSKILSDKLQHDYTVIDQIAEILTRYTSDEPKAKALKRQLGEKLSDEKIESLLALNFTQYGSYSIDTMQCLIPYLAKGYDVTTAIDAFNEDQASLENGHSPLIDASMNYHEIISSIKNPALLQSFTKTVKVVKALIRRYGNPYTIHIEMARELSLGNKGKAELIKKQNENRKRNDKVITEMKENFPNVSINGENIIRLKLYHEQNGIDIYDGRMIDYQHVLDNNYEVDHILPYSISFNNSFNNKVLTSSRNNQLKRNRTPYEWLHNDKVRWDTFTSIAENVRNYPKKNNLLKMHYDESDMKKWKTRSLNDTRYATRLLYNYFKHNEQYFDAKPSVMTMNGSMTAQLRYYWGIVKQRAASDKHHAVDACVIATCSNSMVNLISKYHTAREKEQLSSKFPMPWPDFRNDVMNAKQQMNVKRIFSHSIAGKVNEDGLKGARYINTDKVVVIHEKLANLKLKKVGDDYIIVGHGNSRYLRPDDLTSISNRNSKNDLNSVIYDHIYNALSKDKKAFEKQPYLEFEHKGHKYTVRRVKVISDYKGGVILNRDADGNPISVANRGKMVRNDIFKCLDKKERVVYRFVPIYEHQILDTHLPNQYAPFAKNIFVNDKDQFICSLSKGDAVEVKLSTPKKVENCDEPYVCDHFIGYFDGSDISSNRIKINALDNSCSIRASMSKLISIQKCDVTIFGSIHKVHEKVRQPFNLKHK

SEQ ID NO: 239 - protein, 1362 aa, Lactobacillus paracasei subsp paracasei 8700:2; identical to SEQ ID NO: 205

SEQ ID NO: 240 - protein, 1362 aa, Lactobacillus paracasei subsp tolerans Lpl7
MTKLGKPYGIGVDIGSNSIGFAAVDENSHLIRLKGKTVIGARLFEEGKAAADRRASRTTRRRLSRNRWRLSFLRDFFESHITPTDPNFFMRQKYSEISPKDKSRYKYEKRLFNDRTDAEFYKYENCPTMYHLRNRLMTDPSKADVREIYFAIHHILKSRGHFLTPGDAKDFNTNKVAVNKIFPALQDAYAQVYPDLDITFDENKVNEFKTVLLNEKATPSDTQRALVNLLLAKEGDRDILKQQKQALTEFAKAVVGLKTKLNVALGTEVDSSEATAWNFSLGQLDDKWTGIESAMTDEGTEILDQIRDLYRARLLNGIVPAGKTLSQAKVDDYAQHHEDLELFKDYLKQLEDDGTAKAIRQLYDRYIDGDDAKPFVREDFVKALTKEVTAHPNAKSPELLERLAQPDFMLKQRNKANGAIPVQMQQRELDQIIKNQSVYYDWLAAPNPVEKHRKSMPYQLDELLNFRIPYYVGPLVTAKEQKAAQGGVFAWMVRKDPDGNITPYNFDEKVDREASANTFIQRMKTTDTYLIGEDVLPKQSLLYQSYEVLNELNNVRVNDNKLSFDQKQQVLGELFERHNTVTIKQFVDNLLAHGDYDRIPEVRGLADEKRFLSSLSTYNQLKGILHEAIDDSDKQTDIENIIAWSTIFEDKAIFKTKLNEISWLNAGMINSLANIRYRGWGQFSHKLLNELTLSTGRTVFEELLISSHNLMQILTDEVLKQKIAELNAHELKASGIYAAIDDAYTSPSNKKALRQVLSVIDDITNAAGQAPNWLYIETADGDGVPGKRTNSRQRKIQEIYANAAQELITGSVRGELEDKIASRADFTDRLVLYFMQGGRDIYTGKPLNIDNLSSYDIDHILPQSLIKDNSLDNRVLVHPLVNREKDTIFASTRFAKQMNGMWRQWHAAGLISSRKLRNLQMRPDEIDKYASGFVARQLVETRQIIKLTEQIVADQYPDTKIIAVKAGLSSQLRKELDFPKNREVNHYHHAFDAFLAARIGTYLLKRYPNLEPFFTYGKFKKTEVKKLKSFNFIRDMTHAKDKIVAKETGEIVWDNASDINELDRIYNFKRMLITHEVRFETASLFKQTLYAAKNSKNRGGSRQLIPKKKGYLVDIYGGYTQETGSYLSVVRLTKKAMYAVVKVSTRDAAKLAVAKSISEQKENETLKKIIDGKLSKTSKKGKTTHQLFEIVLPRVGQKTLFKNSKYNQFLVNSDTYMHNYQELWMPREYQRMWKDILLSNHGDAQLEGQLDQIFKFIVSQVNSYFNLYDINQFRKKIADATDKFAKLPTHDTDNARGKIATIGQLLIGLQANAMRSDLRNLDIKTPFGLLQIGTGITLDLDTSIIYQSPTGLFEREVPLTDL

SEQ ID NO: 241 - protein, 1368 aa, Lactobacillus paracollinoides DSM 15502
MDKKYSIGLDIGTSSIGFVGVDENGWPLNIKGKRAIGAHLFREGEAAAETRGFRTTRRRYNRRKWRLRLLREIFDEPISRVDPTFFARMKESSVSPKDPNYDGLAKEILIPRDKDGKILYPTIYHLRHALMYEDHQFDIREIYLAIHHIVKYRGHFLLDGAAKNFESSNLDLKSDIHEINAILVGIFGNEQVQFNDQYVEKLKEVLLDSTQSRSDRQKAAAKLLLPTNDLDKDTTKILKTVSTEITKAITGLKAKFFVITGNDIAKDQQKDWTFSIDTLDEKMSVIEPSFSEKNFSLITILQKLYSSVTLAGIVPNGLSLSEAMIQKYDRHASDLVLLKKYWDTKPKVLKHQLQNTYAEYIEIHQVVDEFYSDLSKLIKNDDDTLAQEIKSKITIGNFLPKQRTTENGVIPYQLQQRELDTIIKNQQEYYPWLAEENPVADHQIAFPYKLDELVGFRIPYYVGPMIAKEDTSNSKNSKFAWMIRKQSGEVTPWNFDEKIDRTASATAFIDRMTTTDTYLIGEDVLPKQSLIYQRFEVLNELNKISIDGQPITRKQKQSVYTHVFEKKKTVQVKDVQKFLVSSGEVMSLPKIGGLANEKQFNSSLSTLYDYNKIIPDALEDRNKVDDIEKIILWSTIFEDNSIFVEKLDSIDWLTSSQRKRLAQKRYRGWGRLSLRLLTTFKNKDGYSILDELWNSNHNFMEIQAQSDFSEQIATANNNNLSQVLPAKWEPGRKNLASLDEFISNLYTSPQNKKALRKAIRVVQDMMTAAGHMPEKIFIEVARDTSNSHQQTIARQRQLQQLYQSEDKEVIDSSVRSELDDILKNRANIKDQLFLYFQQGGRDLYTGKAINIDKLSLYHIDHILPQSLVKDDSLDNRVLVSQKTNEDKGVTFVSDKYMNNMLPTWKRWHEMGLISARKLKNLTMRPDEIDKYAPGFIQRQLVETRQVTKLVIELLDALLGNSQTEIITIKASLSHQFRQQFDLVKIREVNDNHHAFDAFLAARIGTYLYKRYPKLRPYFVYGQYMQNHKNLKSINLIKTLDSDKAIVDEGTGEILWDKKSDLAKMIKIYNYQRLLITHESRTSFGAMYKQKILKATDAKQNGGGFKLVPTKRNRPVDIYGGYTGQTAAYLTIVRVYSKKTSELRVLPIYTNKVQQIEKAMTQGDKATMLAFKKVIAPQLGKENKKTHEIKIPEFDVVIPKVLLDQLVIDDIAGSPHRFRLGTDTYYHNSQQLFLPLSMQRQLMDRESDDKVYLDIFNDVLKQVDSYFNLYDVNGFRAALQKSKKAFEQLPINDFPKDVPDNKKKKGKRSILKEIFIGLHANATLGNLKQMGIKTDFGKLQKSNGLRITENCKIIHQSPTGLFERIVPIK

SEQ ID NO: 242 - protein, 1386 aa, Lactobacillus parakefiri DSM 10551
MCLKEFTGQHYFEEFYRMKVNNYHIGLDIGTSSIGWVAMGEDGKPLRVKGKTAIGARLFREGNPAADRRMFRTTRRRLNRRKWRLKLLDEIFDPYITPVDSTFFARLKQSNWSPKDSRKAFKDSTLFPDLTDKQYHLDYPTIYHLRHALMTQDKQFDIRMVYLALHHIVKYRGNFLNSTPVDSFKASKVNFDDQFKKLNELYTAINPEESFQINFANSEKIGQQFLDPSIRKFDKKKQISKIVPVTMDDKAVDKLNGKIASEIVNAILGYKSKLDVAVQCDPEDSKPWAVKFDDEDIDAKLQKILPEMDENQQSIIGIIQDLYSQVTLNQIVPNGMSLSESMIKKYNDHHDHLKLYKKLIGQISDSKKKTALKKAYDQYVGNDGKVIEQDDFYSSVKKNLDDSELSKQIMDLIDADKFMPKQRTSQNGVIPHQLHQRELDEIIEHQSKYYPWLAESNPNKHDLHLAKYKIEELVAFRIPYYVGPMITPEDQKKSGAAVFSWMKRKEPGQITPWNFDQKVDRMESANKFIKRMTTKDTYLIGEDVLPDESLLYEKFKVLNELNMVRVNGDSLKVADKQAIYQDLFENYKHISVKKMQNYIKDKTGLPNNPDISGLSDPDHFNNSLGTYNDFKKLFGDKVDDPDLQDDFEKIVEWSTVFEDKKILRAKLNEISWLSDKQKDDLESSRYQRWGRLSKKLLTGIVNDQGERIIDELWNTNKNFMQIQSDDDFAKRIHEANADQMKATDVEDVLADAYTSPQNKKAIRQVVKVVDDIQRAMGGVAPKFISIEFTRSEDRNPRRTISRERQLEDTLKDTAKTLVKSMNPDILSELDNASKSKKGLTDRLYLYFTQLGRDMYTGKPINIDEISNYDIDHILPQAFIKDDSLSNRVLVSKAVNNGKSANVPLKLFGVKMAHFWKQLAEAGLINKRKLKNLQTNPDTISKFAMHGFIRRQLVETSQVIKLVANILGDKYRNDDTKIIEITARMNHQMRDEFAFIKNREINDYHHAFDAYLTAFLGRYLYHRYIKLRPYFVYGDFKKFREDKVTMRNFNFLHDLTDDTQARIADTETGEVIWDRETSIKQLRDVYHYKFMLISQEVYTLRGAMFNQTIYPADEAGRKKLIPTKADKAVDVYGGYSGSNDAYMAIVRIHDKKGDKYKVVGVPMRALDRLNAAKNVSDAKYDQVLKDVLTPQFTKSKKSRKTGEISQTVEDFEVVLGKVMYRQLVIDGDKKFMLGSSTYQYNAKQLVLSDESVKTLASKGKLDEAQESAAYDNVYDEILDKVDRYFALYDQRNYRTNLHEGEQKFIGLPLHDTFDGSKKVANGKRETISDILNGLHANATMTNLKVLGISSPFGMFQSHGPINLNPETIILCQSPTGLFERRIILRDL

SEQ ID NO: 243 - protein, 1382 aa, Lactobacillus pentosus IG1
MKKIVNYNLGLDIGTSSIGYAAIDDQGRPVRHQNKTVMGVRLFKEGKTAESTRIFRGTRRRLSHRHWRLGYLDRIFDNEIAKVDENFLPRLKASKRARSDEKRSFRGSLLFPETGDDAYYQKYPTIYHLRYALITQKKQFDIRLIYLALHHMIKYRGNFLDTTPVSAFNIHDIDLTDQFASLNDCYQLLDMDFEFQFDLNNIEQVQKLLLDETLSKTKRQAAVSKVLVMSTGNKAFDDQQNGIASEFIKALLGGPFDLSKILNLSVADVKSWKLHMTDKDVDDTLNSLVEELDENHKQIVNLLQMIYSQVMMLGLLNGQQSISASMIERYDDHAKHWAALKKLLPALGEQEQSTIIHAYTAYTGHSRTKQLSRAEFYTKVNSILKKHENIAEATGLIELIDRNEFMPKQRDAVNGVIPHQLHQRELQLIIQNQQKYYPFLAAKAYPDADETMIEQLLSFRVPYYAGPLVDRDFINESSDQEQAMQNTKFSWLKRREAGEITPWNFEQKVDVQETANRFIKRLTTKDTYLMTEDVLPKESLIYQRFEVLNELNAIRINDRRLTAENKQLAFQQLFMAGNTKNVSIKKFRNFVFDSLKFPEKVKITGFAGQHNFLAKLSTYHDFKKIFGERVDHTDLQPDFERIVEWCTIFEDRHIYREKLKEIQWLSQSEIDQLVLIRNHGWGRLSKRLLTGIRDSDGRTVMDQLWFGTDNFMRIISQSDFAAAIANENRTQLNQHGLEDVLDSAFMSPQNKKAIRQVLKVVDDIEQTLGCPPKKVMIEFTRSPDKKKQRTVTRLEKVQQAYKAVADQLAGQSIVSELDQYANTHSKLSDTYYLYFMQLGRDLYSGKPIDIDSPMLDDDHILPRAFMKDNSLDNRALTEKPINNTKAAKFPSKVFGQQKEVTDFWKLLRRCGLMSNIKEKHLYLDPDNVDKWTRRGFIHRQLVETSQVIKIVANILNDRYQQSQTEVLEVPARLGTELRECFGWYKVREVNDYHHVFDAYLAAFIGNYLYRRYPKLQPYFVYGNFAELNKAQLKNIKSFNFLYNITDNKRVVKDIETGQTLWDDQIRQQIQHIYEYKYMLTSHEAFTQHKELYGQTIYPRREFKPGTLKAIKQDQPQELYGGYKNLTAAYMCIVKIQARKRRAAEYRVVRVATESLSALQQAKRLGVQAYERCLRQELVRNNEILRTNADPNSAPREFEVLLDRVLCHQMIISDGQKYLLGSHAYKINCMQLVLSNNSMKILSTSIVKLKQMTNEPLVQVYREILDVVNKYFTLYDVNSFRENLNQFFDKFRTLPITNEYESSKSGKKLIHRGQLETLTLILRGLHANSDKVQYGDQSTLLGGFQTKDGIKLSKDSVIQYTSPAGLNVRTVKLRDLEQKEAQK

SEQ ID NO: 244 - protein, 1361 aa, Lactobacillus pentosus KCA1
MNEPYGVGLDIGTNSVGWTVVDMNGRVRKVKGKTALGARLFKEGATAEDRRGFRTTRRRLKRVKWRLRLLREFFDQPISKIDPNFFARRKYSDISPRDPNYNGLAKTLFNDRTDKEFYDDYATIYHLRDKLMTSNRKFDIREIYLAIHHIVKYRGNFLRTGPASQYGSASLHLATSFQKLNDLFAQSEETLNLKLVTDEALLQQIQQILVRTDLSRSEQQRQIWPLMAVLTGASAAEKKRQKNVVVELSKALVGLKAKMNVVTLTEVDAAVVKDWTFTMEESQDKLPEIEEQLSEVGQQIMDEVIQLYASVNLAQLIPAGKRFSQHMVEKYKHHEKNLELLKAYIHSQSDSKRGREIRATYDRYIDGVDSKPVTQEMFYKDLMKYVEADATSNHLAAEIKDEIDSEQFMPKLRTKQNGSIPYQVQQYELDQIISHQKKYYPWLGEENPVAERRGKFPYKLDELVGFRVPYYVGPLITKEDQQATSGAGFAWMVRKADGPITPWNFDQKVDRIASATAFIQRMQTTDTYLIGEDVLPARSLIYQRFMVLNELNNMRVEDRKLAPQQKQRLYNQVFKQHQHVSVKNIQQNLMDAGEYRKTPQITGLADPKGFNSSLSTYHDFKKILLEAIADEHKRADIEKIILWSTTFEDSAIFKQKLEEVAWLTDAQRKQLSGLRYRGWGQLSHKLLTAFKDDKGRSIMDGLWETSDNFMQLRKQPAIETQIKEANQANLTDADIQDTINELYTSPQNKKAIREVMLVLDDIKNAMHGQTPSWIFVEAARGGGVAGRRTQSRSSQIVEAYKGTAKEIVSEKVQHELNEKIKAKADFNTRLVLYFLQNGRDLYTNEAINIDRLSEYDIDHILPQSLVKDDSLDNRVLTSARINREKNDTFASEKFGRKMGAQWRELHRNGLMTQRKLKHLLMRPDEISKHATDFINRQLVETRQVIKLVEELISSEYPAASIVAVKANLTHQFRQTFNFPKLREVNDYHHAFDASLTAFIGMYLLKQYPKLERFFVYGKFAKQPINLTRFNIIRKLAVAEKPIANIETGEILWDKTADIKYFEKLYNYKRLLVTHEVRENYGAMFKQTLFKASYNKSKTLVPKKNHMETSVYGGYSNQETAYLAIVRIPFKSGFKFIVVGIPTRMVAKIKHYQSLGATLNQATHKVIEPKFTKISRKTKQTVISDYEVVLPKVYLDQVVRDQVKGQMYRFSLGSDKEYHNVQELYLPLSIQQAFVGHYDESDDQRSNDLVKVYDAALKQLQRYFPLHLSRNFDQVASQAHQSFEGLKNNVQTSDKQLGKKEVLNSLFVGLHANATRSNLSVLGMSKDFGRIKSNGITLTDQAEIIYQSPTGLFERKVALKDL

SEQ ID NO: 245 - protein, 1358 aa, Lactobacillus plantarum EGD-AQ4
MKEPYGVGLDIGTNSVGWTVVDASGHVRKIKGQTGIGVRLFKEGAAAADRRGFRTTRRRLKRVKWRLRLLREFFDQPISKVDINFFARRKYSDVSPRDPNYNGLEKTLFNDRSDQDFYHDYPTIYHLREALMTQHRKFDVREIYLAIHHIVKYRGNFLRNDAATAYRSGTLDLQQHFETLNHLFSQADLELNLNLTTDVALLDSIKQTLVRTDISRSDRQKLIMPLLAVLTGATTAEKKRQKAVVTEFAKALVGNKTKIDVLTLTDIDATEAKDWAFSLEENQDKLPGIEDRFSEVGQQIIDEVIRLYASVNLAQLIPEGKRFSQSMVEKYKRHGEDLKLLKAYIRSQSDAKRGRAIRATYDQYIDGVKSKQVTQEAFQKALGKFVDADVDLNSWAAQIKQAIDSEQFMPKLRTKQNGAIPYQVQQNELDQIISNQKEYYPWLGEENPVIKRRGKFPYKLDELFGFRVPYYVGPLITKEMQAATANAGFAWMVRKADGPITPWNFDDKVDRVASATAFIQRMQTTDTYLIGEEVLPARSLIYQRFMVLNELNNIRVDDGQLTPRQKQRLYNQVFKKHKRVTAKNIQDNLVAAREFPTAPRITGLADPKVFNSSLSTYHDLKQVLPEAMSDVRKQADIEKIILWSTIFEDSTIFKQKLTEISWLTAAQLKQLGQLRYRGWGQLLRKLLTGLKDDNNRSIMDGLWETNANFMQLRSQPAIENQIKSANQANLTTADLQDTINELYTSPQNKKAIREVMVVLADIKDAMHGQTPNWIFVEAARGGGVAGRRTQSRSKQIVAAYQGTAQAIVRDQVQRELKEKIKNKANFNTRLVLYFLQNGRDLYTGDAINIDRLSEYDIDHILPQSLVKDDSLDNRVLTNARINREKNDTFASEKFGKKMGAKWKEMHRMGLMTKRKLDHLLMRPDEISKYATGFINRQLVETRQVIKLVEELINAEYPSTAIVSVKANLTHQFRQTFDFPKIREVNDYHHAFDAALTAFIGTYLLKRYPKLERFFVYGKFAKQPVNLTRFNVIRKLAKTDTPITDIDTGEVLWDKLTDIKYFETLYDYKRLLVTREVSENYGAMFDQTLLKASDNGKRLIRKKQSFDTAIYGGYTGKTLAYMAIVKVSTKKDVQYQVVGVPTTMVTQIEQLEQQGMTNKQAVTKVIEPLIAANNKKMLTYEVLLPKVRFEQVVRDRIKGQTHRFALGTDTYYHNIQELYLPLTLQRAFLGKQNESEVQLNQNLLTVFDATLAQVNRYFPLYEMNKFKKILNSARDQIELLEAKNQFVKNKLVLGKQGILTNMFIGLHANASYGDLKVLGVKIDFGKLQVPGGIKLTGDAEIIYQSPTGLFERKIALKDL

SEQ ID NO: 246 - protein, 1390 aa, Lactobacillus psittaci DSM 15354
MKEVKDYIIGLDIGTNSCGYVVTDKQNNILKLKGKTAIGARLFKEGEAAADRRAFRTTRRRLARRRWRLGLLEEIFDEEMAKVDSSFFRRLKESDYSPKDSRKQFNSIVFESSEADKDFYDKYPTIYHLRNALMHDDQKHDLREIFLAVHHIVKYRGNFLREDSVKAFKAAKFTLQGEDGIGPVDKLNDLLKEIYIEAAPELATDNLSKIEEIIKDKKLYKQDKLKQVATLLTKEADTKDKAKLNKDVAKQVANAFMGYMIIFDTIFNLSDVDSKDYKVKFSDANIDEKLDTLTSLLTDKQTEFVLELQNIYNTIVLNEIVPDGKSLSESMVKKYDDHKEDLKLFKAYLNSLTDVKKVKELKAAYVLYVNNRKANLLAAKKLLGKKADNMNNFEIFSKFVADNLDDSELANKIRARLDLGEFLPKQRTNQNGVIPYQLHQVELTQILEKQGKYYPFLIAPNPVESHRNNAPYRISELVSFRVPYYVGPLIDPNNAESEQDKANSSFAWMVRQKQGQITPWNFEEMVDTTESANKFIKRMTTKDTYLLGEDVLPASSLIYQKFVILNELNNIKVNGIKLTSEEKHQIFDELFKVQKSVSLKNLVNFLTAHGCVAPNVTGLSDGTKFNSSYSTYIDYRKIFGAEIDNKDKQADFEKMIEWSTVFEDRKIFKRKLEEITWLTPDQIKQVSSKRYSGWGRLSKKLLTQITDENGVNILQRLWNESENLMQILSDPVIKEKIVAANSSFTKATDMEDILAEAYTSPQNKKAIRQVMRVVDDIIAAAHGKKPSQIAIEFAREDQDNPQMTKSRKAQLDQIYAKISDEFLDNAVKNELKNMKDNKPLAKDKVFLYFKQMGRDAYTGEKLSLDNLQDYDIDHIYPQSFIKDDSFDNRVLVQRAVNNGKSDNVPVLLFGNKQAADLGMTIRQMWKKWLELGLISKRKFNNLITDPEKISSYMASGFVNRQLVETSQVIKLVANILQAKLPDTEIIEVKASYNSILRKEFNLYKSREVNDYHHAIDAYLTTIVGNYLYQVYPKLRPYFVYGQFKKFGKAESKEDDPVKKIKQFNFIYQLLWGKDDAICISHTDQQVFSRSDIINKLTTAYNFKYMNVSQEVYTNSNNVFKQTVFPIIERDTAKSRSLIPKKLDRPTDIYGGYSNNNDAYLALVKVDKKKGSEYRVVGIPMRAAAMLKASKNYDEDLRKVIEPMVMLDKNGKAKRGIEGFRVLVGKMPFKQAVLDGDKKFMLTGTNDMPNLKQLVLSQQNMKYILDYIDDIDCRKHKFGNKTQDGNKCLLEVFDEIIQIVDKHFELFDNRSFREKLRNSRVNFINLALSKKAEALLAILNGLHANSMRTTIKELKISDLGRIQSSVISPEAQLIYQSPTGLFERRVKVKDL

SEQ ID NO: 247 - protein, 1369 aa, Lactobacillus rennini DSM 20253
MDKPYNIGLDIGSHSIGWTVVDDNSKLVRIKGKLGYGVRLFDEGKTAEERRQFRTTRRRLKRRKWRLRLLREIFEPHIAPLDETFFLRQKQSNLVPTQKKLPQLSLFNDRSDAEFYHKYPTIYHLRNALMTEKRQFDLREIYLAIHHIVKYRGHFLNAAPAASFKSGKFDLENKFDQLNLLFASAYSDLDFTLRTDNVDQVKAILLNEDLSASTRQRQALPLIYQTSADQKAAKKLTKSLATELLKAILGLKAKFDVLTGIETDDTKAWRLTFNAEDFDDKLNELNVTDNEAATQIIEILRELYSSILLAAIVPENYTLSQAMMAKYNAHKQHLSLLRQVKTTLPAKKQKELQAAYDDYIDQHLPLDKFYAKLTKVLPKEKDTDNPQIIQILNLIDLDQFLPKQRTKDNGAIPHQLHQQELDQIIDNQKAYYPWLAQLNPNEKRQKIAKYKLDELVAFRVPYYVGPLIEAKTQQKTSGANFAWMIRKEPGTTTPITPWNFDEKVNRQASANEFIKRMTTTDTYLLGEDVLPKHSLLYQRFEVLNELNGIKIDQKRVTVRQKQAIFNDLFLKQPNVTVKKLQQYLQAKGEYASAPIITGLSDPKKFNSQLSTYHEYKKIFGGLIDDPDKQADFEKCIEWSTIFEDSQILKDKLKEINWLTPEQRHKVANKRYQGWGRLSKKLLTQLVDYNGQRIIDILWNTTDNFMQIVHSEAFDKAIIKENQALLTQYNPQAVIDDLYTSPQNKKALRQILLVVNDIQKALKGQAPSRILIEFAREGQENPRLSTQRKQQVENAYKEASDALLSSAEVRQELKGLDNKALANTRLFLYFMQGGRDIYTGKSLNIDDLSKYDIDHILPQAFIKDNSLDNRVLVSAKMNRSKSDQVPLNDFAEIRYGKQMRQQWEKMLRAGLITRKKYHNLTLNPESINKYTAKGFINRQLVETRQVTKLATNLLVDQYAEDDVQLITVKSNLTHQMREEFDFPKNRNVNNHHHAFDAYLTAFVGLYLLKRYPKLAPYFVYGDYQKGASQNSKWRNFNFLGNLHREKVVDKNTGEIIWQRDAGLGELNRIYNFKKILVTRALRVNRGPMFKQTIYKAEEDKSSGRGSKQLIPTKKNRPTELYGGYTNKETAYLCLVKEPHKKGDIYRICSVLNMWLTELDRIADPIAKAQKLTELLTPQFTTTKKKQGQKIPVVKPFKVVIPKILINQRFFSRGQELTVASPMYMHNEQELFLNKKTIKLLNGQLAKNEAHELAPKIYQQILDQVNDYFPLYDMYKFRDTLNASKEIFVNLPWQDQRQDKKISQSGQKSILNKILIGLHANAARIKLTELNFKSDFGLLSQRSGIAFSPDDQIIYQSPTGLFERRVTLKDL

SEQ ID NO: 248 - protein, 1368 aa, Lactobacillus reuteri Mlc3
MIKKDYNIGLDIGATSVGFAGIDEQYDPIKLKGKTVVGVNLFEEGQTAADRRSFRTTRRRLNRRKWRLSLLEEFFDPYITPVDPAFFARLKESNLSPKDNNKNFSRSLLFPDITDQKFYEEYPTIYHLRYALMTENKKFDLRAIFLAIHHMIKYRGNFLNSTPVAHFDTSKIDFANDFSKLNRLYLNEDPNNIFEINLQNVKEISDILLDHSIKKFDKQKQVAKLLLTSQNDKELDKRNKQIATQISKAILGYNFSLNEILKLEAVNKSKWKLNFSSADIDDTLPDLISELDESQESILNIILSLYSRLTLNGIVPSGMSLSESMIDKYGTHKEHLDLLKKYLKTLPIKNRKEIAEAYAEYVGNSLKKSGHISQEEFYKAVKKNLDKSETAQKILSLISEEKFMPKQRTNQNGVIPYQLHQKELDQIIVNQSQYYPWLAELNPVTEHKDAKYKLDELIAFRVPYYVGPLIDPKTIPQTEQGNKNASFAWMVRKENGQITPWNFDKKVDRISSANNFIKRMTTKDTYLIGEDVLPAHSLIYERFKVLNELNMIRVNGKKLSVSVKQNLYNDLFKQQKTINRKKLANYLQANLGIPERPQITGLSDPEKFNSQLSSYIDLQKILGSEIVDDPNKQDDLEKIIEWSTVFEDSRIYKVKLQEIGWFTEKQKNELVSHRYQGWGRLSKKLLVELKDKNGRSIIDLLWNSQRTFMEIQSRPEFAEQITNENQDKLTEDNYEDVLADAYTSPQNKKAIRQVIKVVDDIVKATGKAPKFISLEFARSDERSDRVKSRKTHIQKIYETTAKELLKDDQLIKELGSVSDLSDRLYLYFTQLGRDMYTGKPINIDEISTMYDIDHILPQAFLKDDSLDNRVLVRRQDNNAKSDTVPALKFGKMKPFWNKLQKHGLISKRKLNNLQTNPESIDKFKAVGFVNRQLVETRQVIKLAANILASRYPDSKIIEVKASLTHQMRESFNLIKNRDVNDYHHAVDAYLSAFVGQYLYNRYPKLQPYFVYGQFKKFDKQSTRIGMKTNHFNFLYDLEPEGKNVKIKKPTKIINKETGEIIGDRDELVAKLNRVYNFKYMLVSQEVYTRSGALFDQTIYPANSGKKLIPLKQNKTTAIYGGYSGSKAAYMSIIRLRDKKGGTYRIVGIPVRAVNKLNQAKKKSNEKYLAELKAVIEPQIAKTKKDRKTGQRVLVPQEFDVIIPEVMYRQLIVDGDQKFTLGGTIDRYNAVQLVLNQEILTFLEQPTKYKDADTKLLDIYDQIVNLVEKYFMLFDSKRLAAGRVAFEKLPTLQPVDKMPSKLIIIRRIIQGLHDNAARTDLKAINGSSSFGRLQKRNGIILSPNACLIYQSPTGLFERKVYLNTISPLK

SEQ ID NO: 249 - protein, 1361 aa, Lactobacillus rhamnosus GG
MTKLNQPYGIGLDIGSNSIGFAVVDANSHLLRLKGETAIGARLFREGQSAAERRESRTTRRRLSRTRWRLSFLRDFFAPHITKIDPDFFLRQKYSEISPKDKDRFKYEKRLFNDRTDAEFYEDYPSMYHLRLHLMTHTHKADPREIFLAIHHILKSRGHFLTPGAAKDFNTDKVDLEDIFPALTEAYAQVYPDLELTFDLAKADDFKAKLLDEQATPSDTQKALVNLLLSSDGEKEIVKKRKQVLTEFAKAITGLKTKFNLALGTEVDEADASNWQFSMGQLDDKWSNIETSMTDQGTEIFEQIQELYRARLLNGIVPAGMSLSQAKVADYGQHKEDLELFKTYLKKLNDHELAKTIRGLYDRYINGDDAKPFLREDFVKALTKEVTAHPNEVSEQLLNRMGQANFMLKQRTKANGAIPVQLQQRELDQIIANQSKYYDWLAKPNPVEKHRASKPYQLDELLTFRIPYYVGPLITPKEQAESRENVFAWMIRKDPSGNITPYNFDEKVDCPASANMFIQRMKNTDTYLIGEDVLPKRSLLYQKYEVLNELNNVSIDGRRLGADQKQRLIREVFERHSSVTIKQVAENLVAHGDFAKRPEIRGLADEKRFLSSLSTYHQLKKILHEAIDDPTKEHDIENIITWSTVFEDAAIFKTELAKISWLDSDTIKALSNIRYRGWGQFSRKLLDGLKLGNGHTVIQELMLSNHNLMQILTDETLKTTMAELNQDKLKADDIEDVINDAYTSPSNKKALRQVLRVVEDIKHAANGQDPSWLYIETADGPGTAGKRTQSRQKQIQTVYANAAQELIDSAVRGELEDKIADKASFTDRLVLYFMQGGRDIYTGAPLNIDQLSHYDIDHILPQSLIKDDSLDNRVLVNATINREKNNVFASTLFASKMAATWRKWHEAGLISGRKLRNLMLRPDEIDKFAHGFVARQLVETRQIIKLTEQIAAAQYPNTKIIAVKAGLSHQLREELDFPKNRDVNHYHHAFDAFLAARIGTYLLKRYPKLAPFFTYGEFAKVDVKKFREFNFIGALTHAKKNIVAKDTGEIVWDKERDIQELDRIYNFKRMLITHEVYFETADLFKQTIYAAKDSKERGGSKQLIPKKQGYPTQVYGGYTRENTAYLAVVKTVEKKADVYRVVRIATSQVAALKEARAQSTVKERELLKKFLTTKFTKIGKNGKKAITPFDIVIPRVPREQLFHNKRYGFFMVNSDTLMHNYQELWMSRSDQQILSKLVKSAKTVENGQVGRLFENIVEQINKYFPLYDINQFRKKLDQSKDIFSKLPLEGNGTTSGKRETIQNILTGAGTGAKNGDLKNLGIKTPFGFLQVPSGIVLDDDTTLIYQSPTGMLNRIVRLSEL

SEQ ID NO: 250 - protein, 1361 aa, Lactobacillus rhamnosus GG; identical to SEQ ID NO: 249

SEQ ID NO: 251 - protein, 1378 aa, Lactobacillus rossiae DSM 15814
MKTFAEEYVMDKSKPYGIGLDIGTNSVGFVATDAEGHLIRLKGKTVIGAYLFNAGISAAERRGFRTTRRRLSRVKWRLGLLREIFETHFQESMGENEDNDFFLRFKYSNISPKDPQFSTAKGLFNDRTDKEFYDQYPTIYHLRRALMTEDHQFDIREIYIAMHHIVKYRGHFLKEGRAKDFKVGDLRLLDNFKMMNEQIEEINPLWQLKLPTDDASIKSITAILLDNTQSQNDRQKAVTKVILATLVKASDKDINAARKRFVGELSKAMVGLKTKLWVLADVSQNGDWEIKYENYADFAETIGSGESDTIQSLFNEINDLYGVITLAGIIPKEAESFSDGMVRKYEHHRKNLELLKVYCAEQSDGKRGRQIRQTYDKYIDGVDSKQFTQEDFYKALSKFTAKDEATSENAKLIAQEIAVGTFMPKLRTKANGTIPHQLHQKELDAIIENQKKYYPWLGEVNPVESHRRALPYKLDELVSFRIPYYVGPMVTPTKGDPEKSKFAWMVRKEPGTITPWNFDQKVDRSASGEAFIQRMKTTDTFLIGEDVLPQQSLLYQKFEVLNELNKIMINGKPICREQKQRLFKQLFMQYKTVTVKKVQQNLIANGEESENVPITGLSDPLRFNSSFSTYIDYKDILGTAAVNDNAKQSDIEQIIAWSTIFEDAAIFREKLNDITWLNDDQRNKLSHKRYRGWGRHSRKLLAGLRDGEGQTIIERLWNTNDNFMQIQNDSEIARQITEANSSKMATAEGTDEIIDGFYTSPENKKALREVMKVVKDIQRAHHGQAPAWVYIESPRETPRPGQRTVSREQQLTDLYEGAAKEIVDDAVLNELKDKVKSKENFTDKLVLYFLQNGHDIYANDSINIDNLNAYDIDHVLPQSLIKDDSLDNRVLTTHERNLKKSNRFATELFADQRKKWEKWHRLGLISSRKLKHLTMQPNSVEKFAHGFIARQLTETRQIIHLTANVLSNLYQENDTKIVMIKAGLNSEFRRTFDFPKNRSVNDYHHAFDAFLTAKIGRYLLARYPKLEPFFVYGNFVKNPKAMKRLSSFDFIAQLAAKTDDTSHIDQRSLKQVPVVNEETGEIVWDKDIELAELDKTYNYKTMLVKRAQTENNAQMFKQTVFKARDNQNKTLIPVKNGLSTDVYGGHSQQAISYLCIVWVGQKKKYRVLGISTAHAGILNNFEKNYGRFEAKKKLQEIVSNTLDNADRNDFKIVAPKVLFEQVVEDDNMKFGLGSASDYRNVQQLFLSRKNQLLLANMMTDQIHDQDLVHLFDEIVGQMNAHFPIFDRGGYRSSLTQSRDKFLKLPFKKNEDLITKQEVIRRILDGLHANANRKDLKIIGSKGDFGRLGTKKIYLSKDAKLIYTSPTCLFTRTVPLSSL

SEQ ID NO: 252 - protein, 1375 aa, Lactobacillus ruminis ATCC 25644
MRKNQEPYNIGLDIGTSSIGWSIMNDNFDLMRVKGKKGIGVRLYNEGQSAAERRMHRTARRRYGRRKWRLRLLEDFFDEHMAEVDDTFFARLKDSNISPKDDKKYRKSLLFPKSKGVTYQDDGEFYKKYPTMYHLRYALMTEHRKFDLREIYLAFHHMVKYRGNFLYDTSVDSFEAKNLDIKGKFDEINDLLSSYTDFYVDNSNAALVESILLEKNTTRKDKSKKIAKLLHVEDKEKGKNKKAKDLATQISNAVLGLKCNFHLIFELQQKYSFDLCSEKTEENIAKLSEVLDENQKMLLMILKEVQDQVMLNAFVPSGMSLSEAMMQKYDDYGEQLKIYHELEHSVSDDSAAKLRGAYRDYNDNIIKRIDGDNKKDTFYKRVKNILTKISKEYVDQDVLESCGKLKKLIDENKLFIRQRTAANGVLPHQLHQIEMRKIIDNQKEYYPWLAEPNPNEKRRVYSKYKVEELIAFRIPYYVGPLVDPNNADKNKEARFSWMVRKKDGEITPWNFYDKVDWAESANNFIERMKSKDTYLLGEDVVPKESMLYQKYEVLNELNNLRINDSGLSDSFEDVKLKQAIYNDLFKKQKIVKITDLQNYLVQNHKYLVKPKISGLADENRFLSSLSTYSDLKTIFGDKVDDRTYFNDFEKMVEYSTVFEDGHDYNQKLDEYTWLTKEEKYKIGKKRYRGWGKLSKKLLTGLRDKNNHTIMDNLWETNRNFMQIQTADEFSKQIAEENERHLKGSVSDAINDMYTSPANKKAIRQVLRVVDDIQKAMGYAPSSISLEFAREDGPSVRTVSRANRMKSIYEKYASEVSEEVMKDLDGVIKDKKGLNDRLYLYFEQQGKDMYSGHPLDFDKVISGQEYDIDHILPQAVIKDDSLDNRVLTTKALNNDVKSKGVPCRMFNGMHSFWKNLYDKGFISRRKFNNLTTNPENIDKYKMKGFVNRQLVETRQIIKLVANVLNDKYQNDDVDIIEVRAELTHDVRKHFKFYKNRNVNDYHHAFDAYLTSFIGHYLFKKYPNLRPLFDYNDFMKVSDNVFKQLRGNNFLGEFLNKTGDIISTDGNFVLNKEEMINKLNKAYAFKKILVTKEVGQRTGAMFNETRYPAPNSRKAALKYRRMPKPDSLISVKDYKNTDIYGGYSGKNDAYMVIVDMGKQYMVVGVPVRYTEKLDKLRIKHSELYRDELRKVLSRDKTLLDSKGNVKRFDIVLDRVLYGQLIEDGNELFTLGSSKYKRNFRQLFLDKQCIEILDSSATPQPTDEELIWVYDQILDKVDKYFELYDINRQRETLRKGRAAFCSLPNISMKKDDVTKKKILNEILVALHANESESNCEKIGKKVFGRLQVPGGIKLSKEAKLIYQSPTGLFERVVYLKDL

SEQ ID NO: 253 - protein, 1369 aa, Lactobacillus sakei carnosus DSM 15831
MAKTYNIGLDIGTNSIGWAVVDDQNHLMSIKGKYGYGVRLYDEGKTAEERRSFRTTRRRLKRRKWRLSLLREIFEPQITPLDNTFFLRQKQSSLSSKDNRKLYPEMSLFNDRTDTDFYTQYPTIYHLSRDLMTKNKQFDIREIYLAMYHIVKYRGHFLNESPVSSFKSSEIKLAENFETLNQIFNERFNESMFQLAVNDFDDLKALLLNDQQSASNRQKKALGMIYVPNENKSLEKQNKAIATELLKAILGLKAKFNVLTGIEVDDAKPWTLSFNSESFDEDIDKAATNIDDDSREIIAILQGLYSGILLAGIIPENQSLSEAMVEKYDQHAAHLKQLKSIYPLLSISDKKAIQQAYNYYIDGQDNAKAYSREDFYAATTKALKSYQDNETIAEILKLIELEQFMPKQRTKDNGAIPHQLHQQELERIIENQQKYYPWLAELNPNESRRKIAKYKLDELVAFRVPYYVGPLITSEQQQQSSNKKFAWMIRKAEGKITPWNFDEKVDRQASANEFIKRMTTTDTYLLAEDVLPKQSLVYQRFEVLNELNGIKIDDVPITVEQKQRIFNDLFMMQASVSVKNIQDYLVSKGYFASRPEITGLSDENKVISRLSTYHDLKAILGGIVDEANKQADLEKCVEWSTIFEDGKIFVEKLNEIEWLTDEQRKRLSSKRYRGWGRLSNKLLNQIVNENGQRIMDLLWDTTDNFMRIVHSEEFDKLISAANQTLLSKNDVQDVINDLYTSPQNKKALRQILLVVSDIQKAMKNQAPSKILIEFAREDEANPRLSVQRKRQVEQVYQNISKDILSDSDVKAELKDLTNTALANTRLFLYFMQGGHDMYTGETLNIDRLSEYDIDHILPQAFIKDNSLDNRVLVSAKMNRSKSDQVPLNDYTEERFGSKMRVQWEQMLRAGLITKRKYDNLTLNPDRISKYAMKGFINRQLVETRQVIKLVTNLLMDHYEDDEVQLITVKSGLIHQMREMFDFPKNRNLNNHHHAFDAYLTAFVGIYLLKRYPKLTPFFVYGSYQKNNTNDKWRNFNFLNDLKKEEVIDSDSHEVIWNKAQGLVELDKIYQFKKILVTREVHENTGALYNQTLYSAKDDKASGQGGKQLIPAKQDRPTALYGGYSGKTVAYMCIVRIKSKKEDTYKVCGVKTSWVAELERLSDSNEQLASLKAKLMPKFTKNKKQKGKTIQVTEDFEIIVPRVLINQRFYDNGQEITLGSATYKHNEQELMLNKKAVKLLNGQLSLVEAETLAPQVYDEILKQVMKYFPLYDTNQFRTKLKMGKEQFIKLPWKNKWDGNKLIHVGQQTVLDRILIGLHANAAVSDLSTLKVTTPFGKLQQPSGIALSLNTKIIYQSPTGLFERRVALRGL

SEQ ID NO: 254 - protein, 1149 aa, Lactobacillus salivarius UCC 118
MERYHIGLDIGTSSIGWAVIGDDFKIKRKKGKNLIGVRLFKEGDTAAERRGFRTQRRRLNRRKWRLKLLEEIFDPYMAEVDKYFFARLKESNLSPKDSNKKYLGSLLFPDISDSNFYDKYPTIYHLRRDLMEKDKKFDLREIYLAIHHIVKYRGNFLEKVPAKNYKNSGASIGFLLEEVNDLYGNIIGNEDVAILDNDKFEDVEKIILNDEIRNIDKQKNVGRLLVKDKKEKNIVTAFSKAIFGYKFNLEDLLLIESDEKNKLTFNDENIDDIFNELSHSLNDNQMDLLTKTREIYFKFKLNMIVPTGYTISESMIEKYEMHKAHLKMYKEFINTLNAKDRKILKNAYSDYINNEKAKAANAQENFYKTVKKTIKENDSDTAKKIIGLIDEGNFMPKQRTGENGVIPHQLHQIELDRIIENQAKYYPWLAEENPVEKNRKFAKYKLDELVTFRVPYYVGPLIDKTESNKNEKETKFAWMVRKAKGTITPWNFENLVDRTESANRFIKRMTSKDTYIIGEDVLPASSLLYEKYKVLNELNNIKVNKKKLDVEQKQHVYLDLFTTRKNVTKDDLATSLNCDVESITGLTDNKKFNSSLSSYIDLKAILGNIVDDYSKNEDLEKIIEYSTIFEDGNIYKEKLSEISWLTDEQIEKLSNIHFKGWGRLSKKLLTQITNENGERIIDTLWNTSNNFIQVISDESIQAKLAEINGEYANKYNLEDILDEAYTSPQNKKAIRQVMKVVEDIEKAMKCEPTSIAIEFTREKRKSKLTNTRYKKISETYEKITDELISEYELGKLQSELDSKVNNMRDRYYLYFMQLGRDMYTGEKMNIDELHQKYDIDHILPQSFIKDDSLNNRVLTSKSVNIKEKSDKTAADLYAAKMGDFWRKLRKQGLMTEQKYKNLLTRTDSINKYTKQSFIKRQLVETSQVVKLAANILQDKYRNTKIIEIRARLNSDLRKKYELIKNREVNDYHHAIDGYLTTFVGQYLYKVYPKLRSYFVYDDFKKLDSNYLKHMDKFNFIWKLEDKKAEDVYDKVNDEFVLNVPEMKEYIRKIYNYKYMLVSKEVTTKNGAFYDQTKYNAKTINLIPIKKDKPTNIYGGYKGKVSSYMMLVKIQKKKEVIYKFVGVPRLWTDELDRLIDTDEKKALLKK

SEQ ID NO: 255 - protein, 1331 aa, Lactobacillus sanfranciscensis DSM 20451
MNKQPYNIGLDIGTSSVGWSATELDNRLLHIKGHNGIGVRLFKEGESAADRRGFRTTRRRLARRKWRLRLLNEIFATEIAKVDPSFFARLKQSNVSPKDPNKTMFENILFDDENLDDQKFHHDYKTIYHLRQAIINHPEQKFDIRLIYLAMHHIIKYRGHFLNQANVQDFKGGKIDLEKSFKALNDIFENQGRDLRLVTDKANQYVKVLSDNAKTRSDRKKELSKLLYVPIDKDTDKNSKKVTGEILKAILGNKAKFDVIFGIEVENPKEWVLTFNSDDFDDKIEGLSSQMTDEDSEILLILKELYFALNLSDILNNSVTDKNAKTLSEAMINRYDDHKNQLAMLKKVIDSSDKKHAKELKEAYSAYIDGENNKKISFEDLKKRIQKNLVDSELSQKINDLLDHDYFLPKQRSKENGAIPHQLQQQELDQIIESQKQYYPFLAELNPNEKRSRQAKYKLDELVAFRVPYYVGPMVEVTDSNQENNGKFAWMIRKEQGEITPWNFDEKVDRTETATKFITRMTTTDTYLIGEPVLPKNSLLYQKFVVLNELNNLKINQEIITPGQKQYLYEHVMKKNKRVTLKKIADALVIKGDYPYAPEVKGTTDQKNLNNGLTTYIDLAKIFGNELDDVDREADFEKIIEWSTIFEDQHIFALKLQELKWLTEKQRNQVVKLRYQGWGKLSKELLAGLVDDNGQRIIDLLWSDNQNFMQIVNQKSFKESIADHNGAHLEEKNLKDVINDLYTSPQNKKAIRQVILVVDDIINAVGYEPANIMMEFAREDSNDHRLTNSRSRQLENVYKDITNSWFDNDSVKDELEDKIKNKDKFTDRLYLYFTQGGKDLYTGEPLNIDDLSSYDIDHILPQSFILDNSLDNRVLTSQRNNRVSKEDQLPGELFGTKMHAFWKRLKAAHLISNKKYYNLTLTPNSISKFNNQGRFINRQLVETRQVIKLAAEILHNRYSEEKGTNIVTIKANLTHHMREKFNFYKNRNVNDYHHAFDAYLTAFVGNWLLQQYPKLKPYFVYGDFAKTEINNLKSFNMLYKFEQAHQLNEKDGKIAKDADALLGYMKNVYHFKKMLVTKKLETNHGALFKQTLYPSPAHDIKKRQLIKPKDNRPTDIYGGYTHEERKYMSLVKVIGKKDNEYRMANVPLLKINKNNDIKEILKSQFSNKKFEIVLPKVLKNQLFSENGALFVIGSKGYKYNANQLVLSDLDMKLLNDLSNNKSIDEVTINQLFKNIVDSTNKYMPLYEIKNLNEVVEKFNNLEFNDKKKTITDFLLATHANPTMSNLKNIGLPSYFGRFTSGNAGIKLSENANVIYQSPTGLFSRKVKISDF

SEQ ID NO: 256 - protein, 1346 aa, Lactobacillus saniviri DSM 24301
MVEHYAIGFDIGTGSTGFAGVDPNGKLVRMRGKNVYGVYRFKGGEAAADRRGFRTTRRRIKRRKWRLRFLKSFFEPYIAPIDPEFFLRQKYSADSPLDPKGIRADKGLLSDMSDQEFHAKYPTIYHLRYQLMHEKRQFDVREIYLAMHHIIKYRGHFLIEDGADNFDAKQIDFFDQFQRMAAVTAGLPELETLVVPDETQSDAFKRVLFDESQTKSDRQKVLASQLLDIQDNQSKAIKDFIAALTKAVVGMKANLATLTSTAIESTDKNDWTKPLGQLDDFLLKHEEDLDEDGYALIDAANQMYSAAVLAALVPEGMGFSEAMMARYAQHKKQLALYKQVIASLPDKTQRHELKDAYADYIEHAAQNPRDAFYKRVTKVLEGVDSADARTVMTAISHDEFLLKQRTLSNGKIPYQMQQHEFDAIIENQKAYYPWLATPNPVEADAKRLPYYLDELIGFRVPYYVGPMVTEKQSQFAWMIRKADGELTPWNFFDVVDREKTANRFIQRMQTTDKYILGEDVLPKHSILYQQFEVLNELNNIRVEKHPLTTEQKQFIYQRLFVDQQRKTITKKNLQDTLVAMGEFDKAPDIGGLAKEDVMMSSLATFADYSKILPEAISDPTRQNDIEDIIAWSTIFEDTQIFFDKLKTVDWLTTQQRKRLASIRYTGWGKLSKRLLQQIPTSKHTNVMAALWATSDNFMQILQDEQFQEGLYDANRLPEETLTPDEQVEKILDEAYLSPADKKGARKVIKVMNDIVRANHGVLPEQVFLESADDPQKNKRRSVSRSKQLEEKYRQAAQSFIDEAVKEELNAQIVNSAEFNDRLVLYFTQNGRDMYTGKRLDIENLGSYQIDHILPQSLVKDDSLDNRALTARDINAEMSNQFVSERFGLGPRAFWQQLKNNGLISGRKFRNLVMQRDEIDKYAPGFINRQLVETRQIIKTVEQIIHRLWPDIQIVTIKANLTHQVRSELGFPKVRELNDYHHAFDALLAARIGQYLLEHYAGLKPFFTYGEFKRGDTKKYGTTNFLRRLTKDNKDKKGELLPEVSDWIDSIDSIYNYKKIPVVWENTTNMSALFDQTIYPRPDRDTTKRKLIPTKLDKPTDIYGGYSSAKTAYMAVMRVQTKKGTEYPVFNIPVSIASQLNRITDQTMLKQQVKQFIINAEQSASKKKLYESGDVILSRVALGQRFTDKNYGEVFLISNMEVQNPQSLWLGRASQQRLTREPEGNEKPETSLADIYQQILKQVDRYFLAFNIRQQRQKLLGTLDQFTSLPVGRVNEQTRTDQNQRSIIARVMIVLGKGSREEKFPEFGLSALGRLVRTGGITLSEDAQIIYQSPTGLFERRVALKDL

SEQ ID NO: 257 - protein, 1345 aa, Lactobacillus senmaizukei DSM 21775
MVEKYGIGLDIGTSTLGWTSVDENGKIQRLKGQTALGTRLFNEGQTAEERRGFRTTRRRIQRRRWRLRLLREIFDEPIGSVDAGFFARQKMSSLSPQDDRFEDTYRLFNNQTDKAFHDEYPTTYHLRQALMNSDRQFDIREIYLAIHHIVKYRGNFLRSGKPADFKTGKLDLKEKFEEINADWQTLISEDAPQLPVDDLTTIKAVLVDGSRSRSDRQRGLVKLWMANETVEKNWKPVMTELAKAILGLKTKLYLLTGLDLPKEDQKAWTFSLDTLEDHQGDIDSFFDDHAQQLIDRLAELRAMIQLTEIIPSGLNFSQSMVQRYEAHRSHLEMYKQYALDQTDPKRTKALRAAYNAYIDQHEIADDFYTAVKRVTKDDQSETAEEINRLIGLEQFMPKQRTKENGVIPYQVHQQELDQIIAHQKKYYPFLGTENPVIDHRESQPYMLDELVSFRVPYYVGPMVAANPELKTTENPFAWMIRKAQGEITPWNFDEKVDRKGSATAFIERMKTTDTYLLGEDVLPQQSLLYQRFMVLNELNNIRIDDELLTTNQKQWVFDRVFKGKGTISAKHLQDALKHHGETDGLPKISGLADPTKFNSALTSYRDFQKWLPNDIDRKDRTADIETIINWSTVFEDTHIFVEKLKEIEWLTADQRRRIASNRYRGWGRLSKHLLTEIKDEQGLSIMDQLWRTQHNFMQIVHEPDYAKQIEAANTVGMAKQDIGTVINDLYTSPQNKKAIRQVLAVVKDIQNAHHGVAPSWIFMEAARGADQNPQRSRQRQRQLQDLYAKTAADLVDTEVQQELTDKIKDKANFTDRLMLYFLQNGQDMYSKEKLNIDRLSEYDIDHILPQALIKDDSLDNRVLVHQSINRNKSDTFASEKYGAKMQGAWHQWRAAGLISARKLRNLEMRPDEISKYATGFIRRQLVETRQVIKLVTEILSHQYNPEETKLVSVKAGLSHELRREAGLPKLRDLNDYHHAIDAYLAARIGTYLLKRYPRLERFFVYGQFQTSRLDLRRFNFIHDLVKSKQGVIVDSDTGEILWDRQKDIDYIKHLMGLKHLLVTHEVYDSAAEMYAQTIFKASDNDSKVLIPTKNDRPTAIYGGYTKRRNGYLAILKITEKKAETYRVVGVPTLYMSQLATARSHSVEAEKALLKSLMAPEILSESKVVSFEVVVSHVHLNQLVRDTVFGPAHYFGLGPFRYVRNFHQLVLPFKDQEILVKRTPTDEELNTVFEDICWQVENYFAVFDINGFRNALKKSIDKFEQLPIENVFKDKKLVTQGKKEVLAFVMQGLHANASYRNLKVSLGIKTPLGQLQLTKFMLSRDAELIDESPTGLFRRIRRLKDL

SEQ ID NO: 258 - protein, 1138 aa, Lactobacillus tucceti DSM 20183
TCVFLVKLGGFEVDRKISLGLDIGVSSVGYSVIDVDTGKVLELGSRLINGKIGTENQARREMRGTRRLINRKKQRRKDTVKLFNEFKLIDSKKDEHYFDHFANNSDPYELRVKGLSEKLSLSEIADGLYHIVKRRGISYDLKDADEESEGSEYENGLKINNSELKNQTPAQIQLKRLNEYGAIRGKVVIDEEKILLNVFPTKAYLDEAKRIIEKQREFYPGILTEEFEEKYCQILTRKRDYFVGPGSEKSRTDYGIYKEDGRTLNNLFEELIGHDKIYPEELRASGASFTAQLFNVLNDLNNLHISSYEDQKLTTENKEQIISELKSTTSNVNMMKLIQKIAGCEESDISGYRTDKNYKPEISSMRIYRKVHKKLLESEIDITNWPDDFINKLSFILTLNTENGEIRNQLKNRLQPEYDFLTDELIQTIIDNKESFDIKSNNKWHRFSIKTMELLIPEMIKRPVEQMTLINEMGLIKNSGKKFSNYKYLPYKKIAEDIYNPVASKSVREALKIVNAILKEYGHIEYIVVEMPRDKNEDEAKDQIEKFQKANGRLKDAALEEFTEAIGDKSTVDKKLGVHRSKLLFKIRLWYQQRGMDLYEGKPISAVDLLNNPDSFQIDHIIPQSVSFDDSFNNKTLCNSGLNQIKDKKTPFEYMNEGYGQGFDSMKAMVMKNPRIDHNKRKNYLFSENVSDIETRKRFISRNLVDTRYASRVVLNNLQEFFKEKESDTKISIIRGKFTSNLRKHWKINKNRDTYHHHAIDATIIAATPFLNIWKKGSSIFPSNVESEDFFDIKTGKIIGNDEFNKYAYDEPYNGFYNELRNATDRIKFSHQIDKKMNRKVSDSTIYSTRVAKSPKNKKESEYIVAKIKNIYDADEYAKFKRIYDKDKTKFLLNKYDPRSFNHLEKIMNTYPDSIERTMSNNKVKVVRISPFELYRQDHGPVKKYSKKNNGPEIKQLKYLDKKVGSSIDVTPDNAKNKHVILKSLKPWRTDIYLNHETGEYEIMGIKYSDLKFNKGEGYGIKKAKYLEIKHREKVSDDSEFMFTLYKKNRIKVENMDESVEMLFWSRTMDSQKGYAELKPIYKYKTEDDNWPIYGNAKKQIIKKLIPKNCKIWKVNTDVLGNPFYVEKEGEYPKDVLD

SEQ ID NO: 259 - protein, 1313 aa, Lactobacillus versmoldensis DSM 14857
KNNLWGARLFKEAETAQVTRGHRSMRRRYRRRRNRLNWLDELFADELAKIDPSFLLRMKNSWVSKKESTRKRDPYNLFIDEKYNDVDYFNQYPTIFHLRKELITEDKKVDIRLIYLAIHNIIKYRGNFTLENQNFDISQLSSNFSQQISDFFALFSDFGVIMPEDFDPDKISDILLNPNLSPSGKVSEAIATISPKTNVKAKIKIILLLLVGNNGDLKKLFDLETTEKIAVKLSSRHIDSELPIILSELNEQQENIITIANSIFGSIILKDFLGDETSISAAKVISFEDHKQDLQKLKTMWRETSNKEAVKAGKKAYEDYIGHEDSETFYKKIKKFLEKAQPVDLANKALAEIELENYLPKQRNRNNTVIPYQLNENELIAILDHQEKYYPFLKENRDKILSLLTFRIPYYVGPLQDSNNNRFSWMTRKASGAIRPWNFSEKVNVEQSSNDFIKRMRSTDTYLIGEPVLPKKSLIYQCYEVLSELNNTRVKDGSSNPKRLDVTIKQRIYNEIFKNQKSVSVKVLQNWLIKESYFKSPEISGLADKKKYLSSLSTYIDFKKIFGQRFVDDPVNSPQLEELAEWLTLFEDKKILLIKLQNSKYSYDQATINKLSTMRYQGTGKLSKKLLVDLKTTKKSIGKSGAESLSILDLMWSTKDNFMQIIHDADYTFEQQIKEFNYDTEDELTPLEKVANLHGSPALKRGLNQSIKVVADIVKFMGHDPEKIFIEFTRSDDFSKLTISRYRRIKKQYLEIAKAIKKIPAEFKDIKEYQTQLEENKGKLASERLMLYFLQCGHSLYSNKPIDLNMINSSKYHVDHILPQSYIKDDSLENKALVLASENENKIDNMLISHDIIATNLPRWQALKDQNLMGSKKFADLTRTTVTENQKKGFIQRQLVQTSQIVKNITLILNDLYKNTSCIETRATLSSEFRKAFSNFDETTYHYQFPEFVKNRDVNDFHHAQDAFLACVIGEYQLKKYPKDNLRLVYDQYSKFLDSLKKDTRKKNGRMPRYTQNGFIIGSMFNGKTYVDDNGEIIWDQKIKESIRKTFNYHQFNVVRQTIEQHGKLFNDTIQPHSDRYKLIPLKTNRDPAIYGGYNNDNNAYSVVLDVDGKKKINGIPIRIANQLKSDELDLSSWLENNIKHKKPMTILIDKVPKYQRIINEETGDLLITSANEVINNVQLFLPSMYTALISLLDSTKTEMYSKLLSNYEANILIDIYDYLLTKLKNNYPLYRKEWAKLAEHRDDFIESDLVTQASTLQQLIKFMHADPSNVNLKFGNFKGNRFGRKNGNIKLSKTDFIYESPTGLFKSIKHID

SEQ ID NO: 260 - protein, 1356 aa, Lactobacillus zymae DSM 19395
KGFINLYKKYGIGLDIGTSSIGWSVVDEYGHIIRVKGQTGLGVRLFREGQPAADRRTFRTTRRRLGRRRWRLRLLREIFDPYIAAQDPNFFARQKASAIAPGDSRFKAVYRLFNDQTDRQFYDKYPTVYHLRQKLMTEKRQFDIREIYLAVHHIVKYRGHFLTGGAAKNFKPGKLDLNTYFATINAQLAAIFMDSQVELPQLDWDAVVSLLTNDQESPSDRQKALTKMLVAQGDATQKRFYTEFSKALLGLKAKLYVLTGFEGDKTDQKALTLSLETLDDHQDDVTQLLGDEQRQLVELLARVQSAIQLAIIIPNGKTFSGQMVQQYQTHYDQLRLLKDYREQLTDQKHRRALKQAYADYLANDQDQDALVKAVEKVLKQNQPLSTVGVRLQTAIDAGDFLPKQRTKANSVIPHQIHQQELDRIIEAQSVYYPWLAEENPVAAHRSYAPYKLDELVDFRVPYYVGPLVQPQADKAAKETKFAWMTRKEAQSTTPITPWNFEQEVDRNASANAFIQRMKTTDTYLLGEDVLPKNSLLYQRFEVLNELNNVRVDGKLLTIAEKQRLFQDLFVDRSQASVTIAQLQANLIAHGAAKDRVEIKGLADPKRFLSSLTTYHDYAQIIPEALEQPDKRADIEKIINWSTIFEDTSIFKEKLQEIAWLTPDQRRQLSQKRYRGWGQLSDKLLTQLRDATGQSVMDLLWTEPNNFMQIIRRTEFQQAIARVNQTDLKQQDLATTINDLYTSPQNKKAIRQVLLVVADIQTAMHEVAPSWLFIEAARGPEQNPKRKLARQQQLLEAYKTSAKEIVNEAVKEKLLSAIDDHQKFEDQVVLYFQQNGLDMYTGKPLDFERLSKYHIDHIIPQSVVKDDSLDNRVLTTPEENERKGARVPGPLYASQQGRWRLLQRAGLISQRKLDHLLLRPEELDQQATGFVARQLVETRQVIKLITNILSQQYDPEQTKLVSVKAGLSHQFRTRLNLPKLRELNDYHHAHDAYLAARIGTYLLQRYPNLERFFVYGQYQKTRFDLKRHFNFIGEMLKGKPEDAVIVKAPHSETVIWDKQDEVKQLKKIMEYRHLLVTHEVYDNHGALFNQTIHPAKNPKNRKLIPRKTTQSTELYGGYSGETTGYLAIARTVTKNKISYQVLRVPTRLVGRLQRSSESAQRQILTDWFAPSFVSRGKQQPFEIVLRHVFKNQTVIDDIHEQSHRFGLRSDTYYCNQQQLVLSLEQQRMIIDQKLNNTNKLMVVYEAVCDQVAKYFPLYRMNHFKESLLEAGPKLAELPINTVQSKNGKLKLGQRSVLLQTMQGLHANPETKDLSIIGCPKYFGKLQVSSGIKLTENAVLIHESPTGLFQRRVRLSDL

SEQ ID NO: 261 - protein, 1355 aa, Leuconostoc gelidum JB7
MTYSIGLDIGTGSVGWAVIGDDYRLKRAKGKNLIGVRLFDSATTAAERRGYRTTRRRLSRRHWRLRLLNDIFASDLAEQDENFLPRLKYSWVNPDDEQNPQLNSDVANGALFGSSETDKAFHKNYPTIYHLRHELMTDTAKHDLREVYLAIHHIVKYRGNFLNTADKINAENSFNVDLFIAALDEYNEFLETPITSIKDAQLFSDKLTDINARNKSVRVENAMSETYDDKSKIFKAILTALVGNTANFQTIFDLSDLEKDEAKNFKFKLDLEDVETKLDVVRAKLSDEQNAFLEAVLIAYDGITLKMILGDYKSISQSMIESYKSHQRDWKYIKNNVRLNEQKIEPDKNSVKFFKLDPKKLIYPSNLAYLQVISSNEDEHRKGLDYFKTAIQDADILQRIENDTFLPRQRTKRNGVLPYQLHLAELEQIIKKQSKYYPFLANIYTQDNKTENKLIGLLKFRVPYYVGPLVEAEKVTGDGKNHWLIKKELQENTPITPFNFDDVVDKDKSGEQFIKRITGTDSYLIGEPTLPENSLLYQKYNVLQELNNVRNERHQRLPIKVKQDIFEHVFKIDKNVNAKKVMAYLKLNGYGDFQIAGLSDTRTGKFNSNLSSYNYFVDLLGREKTEKIREDRLEEIIEIQTVFEDKILVAKRLSNLDFLTPQEKSKLSAKHYTGWGRLSQKLLTTQFIKTALSEAGDIIPQSHSIIDLLYYTDKNLMEILNDKTFNVRNWLTEQNKGTESGNSLYDQIDALAGPKDIKRGITQVFSIIDDIKKAMGSNPETVYLEFARETQTSRLTNSRLNRVQEIYNSPELKTEFAYLAKKLEAETKESIHDDRLYLYYLQEGRDMYTGKEIPFDQISSNYDIDHIIPQAFTKDDSLDNRVLVNRATNARKSNSPTFTNDIIDNRKSWWQSLVKRGLMSKEKFERLTDKRKTFSENQTNHFIARQLVETRQIIKNVADLIKNNYDGTQAVAIRASLTGEMRRYLDWPKNRDMNDYHHAHDALMMATVGKYVDRRGFFDNGSVSDGAGNAYNLYTKDWLVAARVGTRNDSQRVNPYGFIVGSMNSKAVRQQVNKETGEIVWGNENLDYLRHVLSYKKILVTRRLSGSSGRLYAETLFSPNPKAKLIAQKANRSVALYGGFTKAESAYTALVEFNKKGDRSYKLIKVPMAIANRVNDKQITVTAYIASLNLRDFSRVVLEHLPLGTLIRESDGSEFYAASSEYKHNAKELWAPKEILRSSKKLDKATADNLIDIFDFLTNDKTISNFKFYEKDLLHLKNVRDKFVEASDEIKIKVLSDVIYELHNDAGWRDPFKHIQEKPAWTMLQVKGGIKLSEKAAIVYQSPTGLFETITIVGE

SEQ ID NO: 262 - protein, 914 aa, Leuconostoc pseudomesenteroides 4882
MKYSVGLDIGTGSVGAVIGEDYRLKRTKGKNLIGVRLFEGADTAAERRGYRTTRRRLSRRRWRLRLLNDIFASELSKIDENFLPRLKYSWVNKNDTDNVHFGVGVFDNSEQEKAFYQDYPTIYHLRQKLMTDNRQHDLREVYLAIHHIVKYRGHFLNSGEISANSSFDAQKFLELLREFDNTFYPDAVKFLNLDQLDLPDKISSEISDSKISKSERVDRVLQHVQLANSGAKKILKAILNAVVGNSVDSVAMFSLSDLDKEEKKKINHPVTDSKPFKYSDKEVEAKLDELSNLLQDEQKIEFLSLLKLSFDGLTLKMLLGNAKSVSEAMVERYKVHKDDLKFIKENILNSFSKDKKKEFDKYYEAHLAEKDVDNVDKYFKKIIDDSIISKDKKIELLQKIDDHDFLPSQRSKINGAIPHQLHRNELDKIISQQSKYYPFLADSYTQNGKTETKLAGLVNFRVPYYVGPLVSKENADRNNPDGGQNHWVEFKENTSLSNLTPWNFNEIVDKDKSAAKFIERLTGMDTYLIGEPTLPQNSLLYQKYNVLQELNNIRVDNHKLDVKIKQDVFEHLFKTQNSVSAKDVKNYLIANGYAAPSIQITGLSDTNEKTFNSKLSSYNYLVDKLGRTFVESVKSDVLEKIIELQTVFEDKTVLLRQLSMISELTLAQANQLAEKHWTGWGRLSRKLLSSKVVDVNKITNSTFYPATSRQTIIDTLYHTQLNLMEIINNAEDLYGVRQWISEQNKSDSSDTNDVYDQIQELAGDKKIKRGITQSFRILDDIVKAMGGEPERVYLEFARENQQSGVSFSRKNLLSKLYENDSLKQTFKELKSQLESETKENLQNDRLYLYYLQQGRDMYSNDELNIDQLSSYDIDHIIPQAYTKDNSFDNRVLVSSKANRLKRMLLWYPVKLSKK

SEQ ID NO: 263 - protein, 1392 aa, Oenococcus kitaharae DSM 17330
MVFMARDYSVGLDIGTSSVGWAAIDNKYHLIRAKSKNLIGVRLFDSAVTAEKRRGYRTTRRRLSRRHWRLRLLNDIFAGPLTDFGDENFLARLKYSWVHPQDQSNQAHFAAGLLFDSKEQDKDFYRKYPTIYHLRLALMNDDQKHDLREVYLAIHHLVKYRGHFLIEGDVKADSAFDVHTFADAIQRYAESNNSDENLLGKIDEKKLSAALTDKHGSKSQRAETAETAFDILDLQSKKQIQAILKSVVGNQANLMAIFGLDSSAISKDEQKNYKFSFDDADIDEKIADSEALLSDTEFEFLCDLKAAFDGLTLKMLLGDDKTVSAAMVRRFNEHQKDWEYIKSHIRNAKNAGNGLYEKSKKFDGINAAYLALQSDNEDDRKKAKKIFQDEISSADIPDDVKADFLKKIDDDQFLPIQRTKNNGTIPHQLHRNELEQIIEKQGIYYPFLKDTYQENSHELNKITALINFRVPYYVGPLVEEEQKIADDGKNIPDPTNHWMVRKSNDTITPWNLSQVVDLDKSGRRFIERLTGTDTYLIGEPTLPKNSLLYQKFDVLQELNNIRVSGRRLDIRAKQDAFEHLFKVQKTVSATNLKDFLVQAGYISEDTQIEGLADVNGKNFNNALTTYNYLVSVLGREFVENPSNEELLEEITELQTVFEDKKVLRRQLDQLDGLSDHNREKLSRKHYTGWGRISKKLLTTKIVQNADKIDNQTFDVPRMNQSIIDTLYNTKMNLMEIINNAEDDFGVRAWIDKQNTTDGDEQDVYSLIDELAGPKEIKRGIVQSFRILDDITKAVGYAPKRVYLEFARKTQESHLTNSRKNQLSTLLKNAGLSELVTQVSQYDAAALQNDRLYLYFLQQGKDMYSGEKLNLDNLSNYDIDHIIPQAYTKDNSLDNRVLVSNITNRRKSDSSNYLPALIDKMRPFWSVLSKQGLLSKHKFANLTRTRDFDDMEKERFIARSLVETRQIIKNVASLIDSHFGGETKAVAIRSSLTADMRRYVDIPKNRDINDYHHAFDALLFSTVGQYTENSGLMKKGQLSDSAGNQYNRYIKEWIHAARLNAQSQRVNPFGFVVGSMRNAAPGKLNPETGEITPEENADWSIADLDYLHKVMNFRKITVTRRLKDQKGQLYDESRYPSVLHDAKSKASINFDKHKPVDLYGGFSSAKPAYAALIKFKNKFRLVNVLRQWTYSDKNSEDYILEQIRGKYPKAEMVLSHIPYGQLVKKDGALVTISSATELHNFEQLWLPLADYKLINTLLKTKEDNLVDILHNRLDLPEMTIESAFYKAFDSILSFAFNRYALHQNALVKLQAHRDDFNALNYEDKQQTLERILDALHASPASSDLKKINLSSGFGRLFSPSHFTLADTDEFIFQSVTGLFSTQKTVAQLYQETK

SEQ ID NO: 264 - protein, 1378 aa, Pediococcus inopinatus DSM 20285
MKNKDYSIGLDIGTSSIGFAVVDENNHVMRVKGKNAIGVRLFDEGKPAADRRAFRTTRRRLSRRRWRLKLLREIFDSYITPVDEAFFIRLKESNLSPKDSKKQYSGDILFNDRSDKDFYTKYPTIYHLRNALMTEHQRFDIREIYLAIHHIVKFRGHFLNATPANNFQVGKLDLDQKFEDLNDIYQRVFPDDSIEFRIDNLEQIKAVLLDSKRSRSDRQRSLVDDVYQTSEDKEVEKQNKAVATEVLKAILGNKAKLNIIANVEVDKEAAKEWTITFDSESIDDDLAKIDGQMTDDGRAIVEILRSLYSGITLSAIVPENHTLSQAMVAKYDLHKKHLTLLKKLINSMTDTKKAKNLRAAYDGYVDGVKGKVLTQDEFYKQIQSNLDESVEASEIQTYIDQDIFMPKQRTKANGSIPHQLQQQELDQIIENQKEYYPWLAELNPNPDKKRQQLAKYKLDELVTFRVPYYVGPMITAEAQKKQSGAEFAWMIRKESGNITPWNFDQKVDRMATANQFIKRMTTTDTYLLGEDVLPSQSLLYQRFEVLNELNKIRIDRKPISVELKQQIFNDLFKKFKNVTIKHLQDYLVAQGQYSKRPLIEGLADEKRFNSGLSTYNDFCGIFGAKLVDENDRQADLEKIIEWSTIFEDKKIYRAKLNDLAWLTDEQKDKLATKRYQGWGRLSSKLLIGLQNSEHRNIMDLLWIGNENFMQIQADSDFAKLIKDANQNALQNNDSQDVINDLYTSPQNKKAIRQILLVVHDIQNAMHGQAPTKIHVEFAKGEERNPRRSVQRQRQVEAAYEKASNELVGANVREELKDAITNKRDFKDRLFLYFMQGGVDMYSGEPINIDNLSRYDIDHILPQAFVKDDSLNNRVLTDAEKNRRKSDAVPNELFGAKMRVTWERMKEQGLISKGKYRNLTMNPENINKYTENGFINRQLVETRQVIKLAVNILADEYKENTQIISVKADLSHQMREDFELLKNRDVNDYHHAFDAYLAAFMGNYLLKRYPKLRSYFVYGDFKKFTQKEIKLRRFNFIYDLKHEDQVIDKETGEILWNKNEDIAYIRHLFAYKKILISHEVSERRGALYNQTVYKASDDKASGQGSKKLIPIKSDKPTEIYGGYTGRTLAYMTIVKVTKGKKISYKVVGVPTAVLAKMAGVRQGSQEEQDKLYGVLKPQFTHQKENKKTGEITETVDKFDIIVPKVKYQQLVNDNGQLFMIGSDTLPYNAEQLVLSKESVQTINNPGIKDEGSDEESENKKLDNVYDEIVLCMNKYFPLYDNRGFRNSITNGKNKFLKLPIKNIYKNGKLINVGKREVINRILQGLHANASVTDLSNLGIKSPFGFLQKGAGLSLSGEAQLIHQSATGLFEHRVQLNKIK

SEQ ID NO: 265 - protein, 1374 aa, Pediococcus lolii DSM 19927
SGEKRYSEINNVEEEFYMGDRKYNLGLDIGTSSIGFAAVDENNQPIRVKGKTAIGVRLFEEGKTAADRRGFRTTRRRLSRRRWRINLLNGIFDAHLAEVDPTFLARLKESNRSNLDPKKSFQGSLLFPERKDYQFYKEYPTIYHLRKALMEKDRKFDIREIYLAVHHIIKYRGNFLNGTPMRSFKVENIELDTLFDRLNQLYEEIIPDNELAFDLEQVADVKEVLSSTTIYKMDKKKQLVKMMLLPASNKALQSENKKIVTQFVNAILNYKFKLDVLLQVETDADWSLKLNDEGADDKLEEFTGDLDENRLEIIDLLQRLHNWFSLNEITKDGNSLSAAMVEKYKDHRHHLELLKKVIEDHSDAKKAKALKETYTAYVGKTDDKTQNKDDFYKAVEKNLDDSPEAKEIKRLIQLDQFMPKQRTGQNGAIPHQLHQQELDQIIEKQSKYYPFLAEPNPNVKRRKDAPYKLDELIAFKIPYYVGPLVTPEEQAQNKENVFAWMKRKAAGPITPWNFDEKVDRMESANRFIRRMTTKDTYLFGEDVLPAESMIYEKFVVLNELNNLKINGRHLSLKDKQDIYNDLFKQQKTVSIKALQNYYVTKKKAATAPTVGGLADPKKFLSSLSTYIDFKNMFGERVNDPQFQEDLEQIVEWSTIFEDRGIFKAKLQALGWLSEKQIQQLVAKRYKGWGRLSKKLLTGLKNAEGYSILDEMWHSTENFMQIQTRPEFAALIQQANEKQFEGNDPDNVWENIENILGDAYTSPQNKKAIRQVVKVVQDIEKAVGNPPEKIAIEFTREAAANPQRTQSRLRTLEKLYESAEEVVDAGLTAELAEFKENKHVLSDKYYLYFTQLGRDVYTGDTISLDRLNDYDVDHILPQSFIKDDSLDNRVLTIRAVNNGKSDNVPAKMFGKKMGSFWRYLLDNGMISKRKYNNLITDPDNISKYAQKGFINRQLVETSQVIKLTANILNGIYDKDTEIIEVPAKMNSQMRKMFDLVKVREVNDYHHAFDAYLTIFIGNYLYKCYPKLRPYFVYDNFKKFGNKEDIGHKRFNFLGKIERDKKVVAPETGEILWSNVAPNETIKQIKKVYDYKFMLTSHETYTKHGALFNQTIYSAKASKTMIPIKNDRPTKLYGGYSGNEDAYMSIIRLSDKKKTYKVVGISMRDASKLKAYENNAHEEYLKKLKEVIEQQFLDSGKKTKADFEIVIPKVNYHQRMQDGTKQFRIGSSKYVHNTKQLVLSEKTLKAIRNNKQYNGDAEKDLINAFDEILTIVNDSFSIFDIRSFRKKLNESRDKFVSLPVEDTKEKSKVIKGKRETLKQILIALHANGTSQDIPQLGLKSFGKMVKTGGLTLSENTALIHQSPSGLFEHKIKLSDL

SEQ ID NO: 266 - protein, 1374 aa, Pediococcus parvulus DSM 20332 A; identical to SEQ ID NO: 265

SEQ ID NO: 267 - protein, 1375 aa, Pediococcus parvulus DSM 20332 B
MENKKYSIGLDIGTSSIGFAVVDENNRVMRVKGKNAIGVRLFSEGQPAADRRSFRTTRRRLSRRRWRLRLLREIFEPYINPVDEAFFMRLKESNLSPKDANKHYSGDILFNDQSDQKFYEKYPTIYHLRHALMTEHRKFDVREIYLAIHHIVKFRGHFLNAASASNFTVGKLNLEGKFDALNEIYQRVLTDDPFALRTDNLDHIKEILIDNKRSKADRQRTLTGDVYQSSEEKEIEKRNKAIATEILKAAVGNKAKLNVITNVEVDKEAAKDWSLTFDSETIDDELAKVDGQMTDDGREIIEILRSLYSGITLAAIVPENHTLSQSMVEKYNSHKAHLKLLKDLINNMTDTRKAKNLRAAYDGYIDGVKGKVLTRDDFYKQIQGNLDDSAEAQKIQDVMDQDEFMPKQRTKANGSIPHQLQQQELDQIVENQKEYYPWLAEENPNETRRGVAKYKLDELVTFRVPYYVGPMITAEDQEKQSGASFAWMKRKEPGNITPWNFDQKVDRMASANQFIKRMTTTDTYLLGEDVLPAQSLLYQRFEVLNELNKIRIDRKPISIELKQQIFNDLFKKFKNVTIKHLQEYLVATGGYDKRPRIDGLADEKRFNSGLSAYHDLHGILGAEVVDANDKQDDLEKIIEWSTIFEDKKIYRAKLDELTWLTDSQKEKLATKRYQGWGRLSKKLLSGLRNSDHRSILDILWITNENFMQIQADPDFAELVKNANQGMLGKNNSQDVINDLYTSPQNKKAIRQILLVVHDIQNAMHGQAPAKIHVEFARGEERNPRRSIQRQHQIEAAYDKVTSDLLVDAGVRQELKDAINDKRDFKDRLFLYFMQGGRDIYNGEPINIDRLSSYDIDHILPQAFVKDDSLNNRVLTDAEGNRRKSDAVPSELFGAKMRSTWELMREQGLISKAKYRNLTMNPENINAHTENGFINRQLVETRQVIKLAVNILADEYTEDTQIVSVKADLSHQMREDFELLKNRDVNDYHHAFDAYLAAFIGNYLLERYPKLQSYFVYGDFKKFSQKDTKMRRFNFIYDLKHSDQIADKNGKKIWHKTNDLDYIRHLFAYKKILISHEVSERRGALYNQTVYKASDDKASGQGSKKLIPIKANKPTEIYGGYTGKTLAYMAIVKVIKGKKIAYKVVGVPTSALVQLAGIEHGSQEELNRLYDVLKPQFTQLKKNNKTGEISETVSKFEIVIPRVKYQQLVEDDDKLFMIGSDTYPYNAQQLVLSEGALKVINNVYRKGENSDKQESYKLDDVYDEIIIAMKKYFPLYDNRGFREKVAEGKSTFENLPISNEFKNGKLTKIGKKEVINRMLQGLHANATMTDLKILGIKSPFGFMQQPTGIALSENAQLIYQSPTDLFERRVQLNKIK

SEQ ID NO: 268 - protein, 1382 aa, Pediococcus stilesii DSM 18001
SDIVRIDNGLEELKVNNRIYNIGLDIGTSSVGFAVTDAQDKLVRVKGKTAIGVRLFEEGHTAAERRGFRTTRRRLSRRKWRINLLNQIFEPYISEIDPTFFARLKNSSLAGKDKKFEGSLLFPDRTDYQFYKDNPTMYHLRKHLMEKDRQFDLREIYLAMHHIIKYRGNFLNTTPMNHFKNEEIDFSALFSRLNELYQEIDDENIFELNIENVDEIKKILLNHDLFKMEKQKQVAKLLNVDTDDKQLKKENTALASNFSKAILGYKFNLALVTKIPDQDKKEWTISLGDEDFDDRLDNVPVALTESQLEVVEVLHSIFNSISLNEIVENGETLSSAMVRKYNDHKHDLKLLKNVMTTLEDRKKAKKIQGIYNVFVGKDTDLISDKDKNKYKDKDEFYKEIQKNLDNSSDAEEIIKRIKQDQFLPKQRTSKNGVIPHQLHQRELDLIIENQAKYYPFLKEANPNKKRLKQAKYKLDELIAFKIPYYIGPTSGAENSDFSWLKRKKDGQITPWNFDEKVDRIESANRFIRRMTTKDTYLLAEDVLPLESLIYEKYSVLNELNNVRINRQKLSVNDKQDIYNELFKNSKTVTLKQLQKYFEVTKKLKTVVVEGLADPKKFLSNLGTYHDFKLIFGDIVDDPEYQTDLENIIEWSTIFEDRGIFNSKLNEITWLTDEQRKKVLSKRYQGWGRFSKKLLVGLKNSQGNSILDELWNTNLNFMQLQSQDDFAELIHAENAKQFKANDPDNPWNGIDAILNDAYTSPQNKKAIRQVVKVVQDIEKAMGNKPQKIAIEFTRSADKNPRRTDSRIKRLSDIYKEAAEKVVGESLKLELNEYLTSKKKMTDKMYLYFTQLGTDIYTGKKIDIDQLNNYDIDHVLPQSFLKDDSLDNRVLTNRSDNSEKSDTVPLHKFGAKMGNFWRQLADEGLITKRKYKNLTTDPATIDKYTIQGFIRRQLVETSQVIKLTANILGGLYPEETEILEIPAKLNHQFRDMFDLVKVREVNDYHHAFDAYITVFVGNFLYRRYPKLRSYFVYGDFKKLNKTDDDIRKFNFLNLFNKDKVEDNETDEILWSKAESIRDIKNIYNYKFMLVSREVYTRHGAMFNQTIYPASKNDSKKLIPIKKGKDTAIYGGYSGNTDAYMAIVAVEDKKGEKFKVVGVPTRAVSRLEQLAADDHDQYLTALHDVLKPNFTKIKTNRKTKAKEEVTTPFRILVGKVGYRQLIQDGQVKMMLGSSAYKYNAKQLVLSEKSLKVIKNNKKYNPDDENQDLIDVYDEILGVVNRAFNLYDTNGFRKKLNDNRVKFVELPINNIFDGTKLVQMGKRAVLTQILNGLHANAALGDLKALGISTPFGKMQSKSGIPLSMDASLVYQSPTGLFERKLNLSDL

SEQ ID NO: 269 - protein, 1370 aa, Steptococcus agalactiae GB00300
MNKPYSIGLDIGTNSVGWSIITDDYKVPAKKIRVLGNTDKEYIKKNLIGALLFDGGNTAADRRLKRTARRRYTRRRNRILYLQEIFAEEMSKVDDSFFHRLEDSFLVEEDKRGSKYPIFATLQEEKYYHEKFPTIYHLRKELADKKEKADLRLVYLALAHIIKFRGHFLIEDDRFDVRNTDIQKQYQAFLEIFDTTFENNDLLSQDVDVEAILTDKISKSAKKDRILAQYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIVADSSKDGYAGYIEGKTNQEAFYKYLSKLLTKQEGSEYFLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIKKRLDIYKDFFTESQLKKLYRRHYTGWGRLSAKLINGIRNKENQKTILDYLIDDGSANRNFMQLIKDAGLSFKPIIDKARTGSHSDNLKEVIGELAGSPAIKKGILQSLKIVDELVKVMGYEPEQIVVEMARENQTTAKGLSRSRQRLTTLRESLANLKSNILEEKKPKYVKDQVENHHLSDDRLFLYYLQNGKDMYTDDELDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFVFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRTDKLIILPKYSLFELENGRRRLLASAGELQKGNELALPTQFMKFLYLASRYNESKGKPEEIEKKQEFVNQHVSYFDDIFQIINDFSKRVILADANLEKINRLYQDNKENIPVDELANNIINLFTFTSLGAPAAFKFFDKIVDRKRYTSTKEVLNSTLIHQSITGLYETRIDLGKLGED

SEQ ID NO: 270 - protein, 1370 aa, Steptococcus gallolyticus ATCC BAA-2069
MTKKNYSIGLDIGTNSVGWAVITDDYKVPAKKMKVLGNTDKKYIKKNLLGALLFDSGETAEATRLKRTARRRYTRRKNRLRYLQEIFAEEMTKVDESFFYRLDESFLTTDEKDFERHPIFGNKAEEDAYHQKFPTIYHLRNYLADSSEKADLRLVYLALAHMIKYRGHFLIEGKLNAENTDVQKLFTDFVGVYDRTFDDSHLSEITVDVASTLTEKISKSRRLENLIKYYPTEKKNTLFGNLIALALGLQPNFKMNFKLSEDAKLQFSKDTYEEDLEELLGKIGDDYADLFTSAKNLYDAILLSGILTVDDNSTKAPLSASMIKRYVEHHEDLEKLKEFIKANKSELYHDIFKDKNKNGYAGYIENGVKQDEFYKYLKNTLSKIDGSDYFLDKIEREDFLRKQRTFDNGSIPHQIHLQEMHAILRRQGDYYPFLKEKQDRIEKILTFRIPYYVGPLVRKDSRFAWAEYRSDEKITPWNFDKVIDKEKSAEKFITRMTLNDLYLPEEKVLPKHSHVYETYAVYNELTKIKYVNEQGKESFFDSNMKQEIFDHVFKENRKVTKEKLLNYLNKEFPEYRIKDLIGLDKENKSFNASLGTYHDLKKILDKAFLDDKVNEEVIEDIIKTLTLFEDKDMIHERLQKYSDIFTANQLKKLERRHYTGWGRLSYKLINGIRNKENNKTILDYLIDDGSANRNFMQLINDDTLPFKQIIQKSQVVGDVDDIEAVVHDLPGSPAIKKGILQSVKIVDELVKVMGDNPDNIVIEMARENQTTNRGRSQSQQRLKKLQSSLKELGSNILNEEKPSYIEDKVENSHLQNDQLFLYYIQNGKDMYTGDELDIDHLSDYDIDHIIPQAFIKDDSIDNRVLTSSAKNRGKSDDVPSLDIVRARKAEWVRLYKSGLISKRKFDNLTKAERGGLTEADKAGFIKRQLVETRQITKHVAQILDARFNTEHDENDKVIRDVKVITLKSNLVSQFRKDFEFYKVREINDYHHAHDAYLNAVVGTALLKKYPKLASEFVYGEYKKYDIRKFITNSSDKATAKYFFYSNLMNFFKTKVKYADGTVFERPIIETNADGEIAWNKQIDFEKVRKVLSYPQVNIVKKVETQTGGFSKESILPKGDSDKLIPRKTKKVYWDTKKYGGFDSPTVAYSVFVVADVEKGKAKKLKTVKELVGISIMERSFFEENPVEFLENKGYHNIREDKLIKLPKYSLFEFEGGRRRLLASASELQKGNEMVLPGYLVELLYHAHRADNFNSTEYLNYVSEHKKEFEKVLSCVEDFANLYVDVEKNLSKIRAVADSMDNFSIEEISNSFINLLTLTALGAPADFNFLGEKIPRKRYTSTKECLTATLIHQSITGLYETRIDLSKLGEE

SEQ ID NO: 271 - protein, 1126 aa, Steptococcus henryi DSM 19005
MTNGLVLGLDIGIASVGVGIIEAETGKVIHASSRIFPAANADNNAERRGFRGGRRLTRRKKHRVKRVRDLFDDYNIATDFSNLNLNPYELRVKGLTEELTNEELFAALRNISKRRGISYLDDAEDDANSGKTDYAKSVLANKELLKTQTPGQIQLDRLNKYGQLRGDFDVVDENGEIHRVINVFSTSDYRKEAEKILQTQSQFNNAINQEFINDYIDILVSKRKYYHGPGNEKSRTDYGRYRTDGRTLENIFDILVGKCTFYPEEYRAAKASYTAQEFNFLNDLNNLTLPTETKKLSIEEKLYLVDYAKNTPVLGPDKLLKEIAKLVDCKKEDIKGFRIDNKEKPDMHTFEVYRTMSKLDKVDIQTLSRETFDELARILTLNTEREGIEEAILKDLPNQFTNEQIEELIKFRKDKSQIFGKGWHNFSVKLMLELIPELYDTSEEQMTILTRLGKTSANKKEVKRTKYINENDVTEEIYNPVVVKSVRQAIKIINASVKEWGEFDNIVIEMPRETNADDERKFIKKMQDANAKEKKDSEERAATLYNGKTELPSNIFHGHNQLATKIRLWYQQGERCIYTGQKIDINDLIHNHNMYEIDHVLPLSLSFDDSLANKVLVLATANQEKGQKTPFQSIPQMKSAWSYREFKSYVLGCKGLSKKKREYLLTEEDINKIEVKQKFIERNLVDTRYASRVVLNTLQDSLKAMNKKTRVSVVRGQFTSQLRRQWKIDKSRETYHHHAIDALIIAASSQLRLWKKQGDTMFEDYKNGQKVDLETGELLSDNEYKELVFQSPYQGFVNTISSKAFEDEILFSYQVDSKVNRKISDATIYATRQAKLTKDKKEETYVLGKIKDIYSQAGYDAFRKRYEKDKSAFLMYQKDPMTWEKVIEVILNDYCEFDDKGKETGNPFEKYRNENGYIRKYSRKGKGTEIKSLKYYDSKLGNHIDITPENSKNSVVLQSINPWRADLYFNPKTLKYELMGLKYSDLSFEKGTGNYSISQDKYDEIKSREGISPKSEFKFTLYKNDLILIKDTINNKTLTARFNSKNDTSKHYVELKPDSKAKYDSEEVLIPVFGKVAKSGRFIKGINKTGISIYKIKTDILGRKHFIKEEGDQPKLEFMKSSKNNK

SEQ ID NO: 272 - protein, 1128 aa, Steptococcus mutans NLML5
MANSKILGLDIGIASVGVGIIDKETGKIIHVNSRIFPAATADSNVERRGFRQGRRLVRRKKHRKVRLADLFLDSNLLTDFSKVSLNLNPYQLRVKGLNEELSNEELFIALKSIVSRRGISYLDDASEDSGANSSEYGKAVEENRKLLEDRTPGQIQLERFEKYGKVRGDFTVVENGENHRLINVFSTSAYKKEAERILRRQQEFNIRIADEFIEAYLTILTGKRKYYHGPGNEKSRTDYGRFRTDGTTLDNIFGILIGKCTFYPDEYRAAKASYTAQEFNLLNDLNNLTVPTETKKLSEEQKRQIIEHAKTVKTLGAPTLLKYIAKLVGCSADDIKGYRIDKSDKPEIHTFEAYRKMRTMELIKVADLSRESLDALAHILTLNTEREGIEEAIRDRFTNKEFNQEQINELVLFRKNNSSLFGKGWHNFSLKLMKELIPELYETSEEQMTILTRLGKQRVKKSSNRTNYIDEKELTEEIYNPVVAKSVRQAIKIINLATKKYGVFDNIVIEMARESNEDDEKKAIQNAQKANEDEKEAALLKAAHQFNGKEELPDSIFHGHKELLTKIRLWHQQGEKCLYTGKTIFINDLIHNPYKYEIDHILPLSLSFDDSLANKVLVLSTANQEKGQRTPFQSLDSMDGAWTYREFKAYVKGLKTLSNKKKDYLLNEEDINKNEVKQKFIERNLVDTRYSSRVVLNTLQDFYKKREFDTKISVVRGQFTSQIRRKWRIEKTRETYHHHAVDALIIAASSQLNLWKKQNNPLISYKEDQFVDPETGEILSLSDDEYKELVFKAPYDHFVDTLKSKKFEDSILFSYQVDSKYNRKISDATIYGTRKARLGKDSQEETYVLGKIKDIYSQKGYEDFIKKYKKDKTQFLMYHKDPQTFEKVIEEILKTYSDKELNEKGKEVPCNPFEKYRQENGPVRKYSKKGNGPEIKSIKYYDNKLGNHIDITPNNSHHQVVLQSLKPWRTDVYFNPKSGKYELMGLKYSDLRFEKVSGDYGISVKKYNEIKSKEGVDENSEFKFTLYKNDLILIKDTESGEQELFRFLSRTMPNQKHYVELKPYDKSKFEGHQKLMDIFGEVAKGGQCLKGLNKSNISIYKVKTDVLGNKYFIKKEGDQPQLNFKKKI

SEQ ID NO: 273 - protein, 1373 aa, Steptococcus oralis SK304
MENKNYSIGLDIGTNSVGWAVITDDYKVPSKKMKVLGNTDKRFIKKNLIGALLFDEGTTAEARRLKRTARRRYTRRKNRLRYLQEIFAEEMSKVDSSFFHRLDDSFLIPEDKKGSKYPIFATLIEEKEYHKQFPTIYHLRKQLADSKEKTDLRLIYLALAHMIKYRGHFLYEDTFDIKNNDIQKIFNEFISIYNNTFEGNSLSGQNVQVEAIFTDKISKSAKRERVLKLFPDEKSTGLFSEFLKLIVGNQADFKKHFDLEEKAPLQFSRDTYDEDLENLLGQIGDDFADLFVAAKKLYDAILLSGILTVTDPSTKAPLSASMIERYENHQKDLATLKQFIKTNLPEKYDEVFSDQSKDGYAGYIDGKTTQESFYKYIKNLLSKFEGADYFLEKIEREDFLRKQRTFDNGSIPHQIHLQEMNAILRRQGEHYPFLKENKEKIEKILTFRIPYYVGPLARGNRDFAWLTRNSDQAIRPWNFEEIVDKASSAESFINKMTNYDLYLPEEKVLPKHSLLYETFAVYNELTKVKFIAEGLRDYQFLDSRQKKDIFYTLFKAEDKRKVTEKDIIQYLHTVDGYDGIELKGIEKQFNASLSTYHDLLKIIKDKEFMDDPNNEEILENIVHTLTIFEDREMIKQRLAQYDSLFDEKVIKALTRRHYTGWGKLSSKLINGIRDKQTGKTILDYLMDDGYNNRNFMQLINDDELSFKEIIKKAQVVGKTDDVKQVVQELPGSPAIKKGILQSIKLVDELVKVMGHEPESIVIEMARENQTTARGKKNSQQRYKRIEDSLKILASGLNAKILKEHPTDNIQLQNDRLFLYYLQNGRDMYTGKPLDINQLSSYDIDHIVPQAFIKDDSLDNRVLTSLKDNRGKSDNVPSLEVVEKMKTFWQQLLDSKLISYRKFNNLTKAERGGLDERDKVGFIKRQLVETRQITKHVAQILDARYNTEVNEKDKKNRTVKIITLKSNLVSNFRKEFRLYKIREINDYHHAHDAYLNAVVAKAILKKYPKLEPEFVYGDYQKYDLKRYISRSKDPKEIEKATEKYFFYSNLLNFFKEEVHYADGTIVKRENIEYSKDTGEIAWNKEKDFATIKKVLSLPQVNIVKKREVQTGGFSKESILPKGNSDKLIPRKTKDILWDTTKYGGFDSPVIAYSILLIADIEKGKAKRLKTVKTLVGITIMEKATFEKSPIAFLENKGYHNVRKENILCLPKYSLFELKNGRRRMLASAKELQKGNEIVLPVHLTTLLYHAKNIHRLDEPEHLEYIQKHRNEFKGLLNLVSEFSQKYVLADANLEKIKNLYADNEQADIEILANSFINLLTFTALGAPAAFKFFGKDVDRKRYTTVSEILNATLIHQSITGLYETRIDLSKLGED

SEQ ID NO: 274 - protein, 1125 aa, Streptococcus anginosus 1_2_62CV
MNGLVLGLDIGIASVGVGILNKETGEIIHANSRIFPAATADSNVERRGFRQGRRLGRRKKHRSARLNNLFEEFGFITDFSAIPLNLNPYALRVKGLSEELTNEELFIALKNIIKRRGISYLDDASEDGETASNEYGKAVEENRKLLADKTPGQIQLERFEKYGQVRGDFTVVENGENHRLINVFSTSAYKKEAERILRRQQEFNVRISDEFIEAYLTILTGKRKYYHGPGNEKSRTDYGRFRTDGTTLDNIFGILIGKCTFYPDEYRAAKASYTAQEFNLLNDLNNLTVPTETKKLSPEQKRQIVEYARTAKTLGTPTLLKYIAKLVDGSIDDIKGYRIDKSDKPEMHTFDAYRKMRTLDLVNIDALSRETLDDLAHILTLNTESEGILEALNSKMPSTFTKEQIDELIQFRKKNSAVFGKGWHNFSLKLMNELISELYETSEEQMTILTRLGKQRSREISKRTKYIDEKELTEEIYNPVVAKSVRQAIKIINEATKRYGIFDNIVIEMARENNEEDAKKDYIKRQKANQDEKNASMEKAAFQYNGKKELPDSIFHGHKELATKIRLWHQQGERCLYTGKNISIRDLIHNPHQYEIDHILPLSLSFDDGLANKVLVLATANQEKGQRTPFQAIDSMDDAWSYREFKQYVRNSKSLSNKKKDYLLTEEDISKIEVKQKFIERNLVDTRYSSRVVLNTLQEFYKTNDFDTKISVVRGQFTSQLRRKWKIEKSRDTYHHHAVDALIIAASSQLRLWKKQNNPLISYKEGQFVDPETGEILSLTDDEYKELVFRPPYDYFVDTLKSKSFEDSILFSYQVDSKYNRKISDATIYGTRKAQLGKDKQEETYVLGKIKDIYSQKGYEDFIKRYNKDETQFLIYHKDPQTFEKVIEEILKTYPDKELNEKGKEIPCNPFEKYRQENGPIRKYSKKGKGPEIKSLKYYDNKLGNHIDITPVNSQNQVVLQSLKPWRTDVYFNPRTSKYELMGLKYSDLRFEKGSGSYGISPEKYNKVKAKEGVNEDSEFKFTLYKNDLILIKDTETGEQQLFRYGSRNDTSKHYVELKPYEKAKFEGNQQLMNLLGTVAKGGQCLKGINKPNLSIYKVKTDVLGNKYFIKKEGDQPQLNFKKKF

SEQ ID NO: 275 - protein, 1396 aa, Streptococcus anginosus DSM 20563
MTKPYSIGLDIGTNSVGWAVITDDYKVPAKKMKVLGNTNRDYIKKNLLGALLFDGGETAEGRRLKRTARRRYTRRKNRLRYLQEIFAEEMMQVDESFFQRLDDSFLVEEDKQGSKYPIFGTLKEEKEYHKKFKTIYHLREELANSKEKADLRLVYLALAHMIKFRGHFLYEGDLKAENTDVQALFKDFVEEYDKTIEESHLSEITVDALSILTEKVSKSSRLENLIAHYPTEKKNTLFGNLIALSLGLQANFKTNFQLSEDAKLQFSKDTYEEDLEGLLGEVGDEYADLFVSAKNLYDAILLSGILTVDDNSTKAPLSASMVKRYKEHKEELAAFKRFIKEKLPKKYEEIFKDDTKNGYAGYVGADKKLRKRSGKLATEEEFYKYVKGILNKVEGADYFLDKIDREDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSPLYETFTVYNELTKVKYVNEQGEAKFFDTNMKQEIFDHVFKENRKVTKDKLLNYLNKEFEEFRIVNLTGLDKENKAFNASLGTYHDLRKILDKSFLDDKVNEKIIEDIIQTLTLFEDREMIRQRLQKYSDIFTTQQLKELERRHYTGWGRLSYKLINGIRNKENKKTILDYLIDDGYANRNFMQLINDDALSFKEEIARAQIIGDVDDIANVVHDLPGSPAIKKGILQSVKIVDELVKVMGHNPTNIIIEMARENQTTDKGRRNSQQRLKLLQDSLKNLDNPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTENDKAGFIKRQLVETRQITKHVAQVLDARFNAKHDENKKVIRDVKIITLKSNLVSQFRKDFKFYKVREINDYHHAHDAYLNAVIGTALLKKYPKLASEFVYGEFKKYDVRKFIAKSDKEIGKATAKYFFYSNLMNFFKKEVKFADGTVVERPDIETSEDGEIAWNKQTDFKIVRKVLSYPQVNIVKKTEVQTHGLDRGKPRGLFNANPSPKPKPDSSENLVGIKRNLDPKKYGGYAGISNSYAVLVKAIIEKGVKKKETMVLEFQGISILDRITFEKDKRAFLLGKGYKDIKKIIELPKYSLFELKDGSRRMLASILSTNNKRGEIHKGNELFVPQKFTTLLYHAKRINNPINKDHIEYVKKHRDDFKELLNYVLEFNEKYVGATKNGERLKEAVADFDSKSNEEICTSFLGAVNSKNAGLFELTSLGSASDFEFLGVKIPRYRDYTPSSLLKDSILIHQSITGLYETRIDLSKLGED

SEQ ID NO: 276 - protein, 1155 aa, Streptococcus dysagalactiae subsp equisimilis
MDKKYSIGLDIGTNSVGWAVITDDYKVPSKKFKVLGNTDRHSIKKNLIGALLFDSGETAEATRLKRSARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKTYAHLFDDKVMKQLKRRHYTGWGRLSRKLINGIRDKQSGKTILDFLKSDGFANRNFIQLIHDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNRRDMYVDQELDINRLSDYDVDHIVPQSFIKDDSIDNKVLTRSDKNRGKSDDVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKYQSYKMEK

SEQ ID NO: 277 - protein, 1348 aa, Streptococcus equi subsp zooepidemicus
MKKPYTIALDIGTNSVGWVVVTDDYRVPTKKMKVLGNTERKTIKKNLIGALLFDSGDTAEGTRLKRTARRRYTRRKNRLRYLKEIFTEEMAKVDDGFFQRLEDSFYVLEDKEGNKHPIFANLADEVAYHKKYPTIYHLRKELVDNPQKADLRLIYLAVAHIIKFRGHFLIEGTLSSKNNNLQKSFDHLVDTYNLLFEEQRLLTEGINAKELLSAALSKSKRLENLISLIPGQKKTGIFGNIIALSLGLTPNFKANFGLSKDVKLQLAKDTYADDLDSLLAQIGDQYADLFLAAKNLSDAILLSDILTESDEITRAPLSASMVKRYREHHKDLVTLKTLIKDQLPEKYQEIFLDKTKNGYAGYIEGQVSQEEFYKYLKPILARLDGSEPLLLKIDREDFLRKQRTFDNGSIPHQIHLEELHAILRRQEVFYPFLKDNRKKIESLLTFRIPYYVGPLARGHSRFAWVKRKFDGAIRPWNFEEIVDEEASAQIFIEKMTKNDLYLPNEKVLPKHSLLYETFTVYNELTKVKYATEGMTRPQFLSADQKQAIVDLLFKTNRKVTVKQLKENYFKKIECWDSVEITGVEDSFNASLGTYHDLLKIIQDKDFLDNPDNQKIIEDIILTLTLFEDKKMISKRLDQYAHLFDKVVLNKLERHHYTGWGRLSGKLINGIRDKQSGKTILDFLKADGFANRNFMQLIHDSELSFIDEIAKAQVIGKTEYSKDLVGNLASSPAIKKGISQTIKIVDELVKIMGYLPQQIVIEMARENQTTAQGIKNARQRMRKLEETAKKLGSNILKEHPVDNSQLQNDKRYLYYLQNGKDMYTGDDLDIDYLSSYDIDHIIPQSFIKNNSIDNKVLTSQGANRGKLDNVPSEAIVRKMKGYWQSLLRAGAISKQKFDNLTKAERGGLTQVDKAGFIQRQLVETRQITKHVAQILDSRFNTEFDDHNKRIRKVHIITLKSKLVSDFRKEFGLYKIRDINHYHHAHDAYLNAVVAKAILGKYPQLAPEFVYGDYPKYNSFKERQKATQKTLFYSNILKFFKDQESLHVNSDGEEIWNANKHLPIIKNVLSIPQVNIVKKTEVQTGGFYKESILSKGNSDKLIPRKNNWDTRKYGGFDSPTVAYSVLVIAKMEKGKAKVLKPVKEMVGITIMERIAFEENPVVFLEAKGYREIQEHLIIKLPKYSLFELENGRRRLLASASELQKGNELFLPVDYMTFLYLAAHYHELTGSSEDVLRKKYFVERHLHYFDDIIQMINDFAERHILASSNLEKINHTYHNNSDLPINERAENIINVFTFVALGAPAAFKFFDATIDRKRYTSTKEVLNATLIHQSVTGLYETRIDLSQLGEN

SEQ ID NO: 278 - protein, 1136 aa, Streptococcus gordonii Challis substr CH1
MNGLVLGLDIGIASVGVGILEKDTGKIIHASSRLFPAATADNNVERRSNRQGRRLNRRKKHRSVRLQDLFEGYGLLTDFSKVSMNLNPYQLRVQGMENQLTNEELFVALKNIVKRRGISYLDDASEDGGTVSSDYGKAVEENRKLLAEKTPGQIQLERFEKYGQLRGDFTVEENGEKHRLINVFSTSAYRKEAERILRKQQEFNSKITDEFIEDYLIILTGKRKYYHGPGNEKSRTDYGRFRTDGTTLDNIFGILIGKCTFYTEEYRASKASYTAQEFNLLNDLNNLTVPTETKKLSEEQKKLIIEYAKSAKTLGASTLLKYIAKMIDASVDQIRGYRVDVNNKPEMHTFEVYRKMQSLETIKVEELPRKVLDELAHILTLNTEREGIEEAINSKLKDIFNRDQVLELVQFRKNNSSLFSKGWHNFSIKLMMELIPELYETSEEQMTILTRLGKQRSKETSKRTKYIDEKELTEEIYNPVVAKSVRQAIKIINEATKKYGIFDNIVIEMARENNEEDAKKDYIKRQKANQDEKNAAMEKAAFQYNGKKELPDNIFHGHKELTTKIRLWHQQGEKCLYTGKNIPISDLIHNQYKYEIDHILPLSLSFDDSLSNKVLVLATANQEKGQRTPFQALDSMDDAWSYREFKSYVKDSKLLSNKKKDYLLTEEDISKIEVKQKFIERNLVDTRYSSRVVLNALQDFYKSHQLDTTISVVRGQFTSQLRRKWGIEKSRETYHHHAVDALIIAASSQLRLWKKHSNPLIAYKEGQFVDSETGEIVSLSDEEYKELVFKAPYDHFVDTLRSKKFEDSILFSYQVDSKYNRKISDATIYATRKAKLDKEKKEYTYTLGKIKDIYALGTKTPSKTGFYKFLDLYKTDKSQFLMYQKDRKTWDEVIEKIIEQYRPFKEYDKNGKEVDFNPFEKYRIGNGPIRKYSKKGNGPEIKSLKYYDILLGKHKNITPDGSRNTVALLSLNPWRTDVYYNSETKKYEFLGLKYADLCFEEGGAYGISEVKYKKIREKEGIGKNSEFKFTLYKNDLILIKDTETNCQQFFRFWSRTGKDNPKSFEKHKIELKPYEKAKFEKGEELKVLGKVPPSSNQFQKNMQIENLSIYKVKTDILGNKHFIKKEGDEPKLKFKK

SEQ ID NO: 279 - protein, 1129 aa, Streptococcus infantarius subsp infantarius
MSNGKILGLDIGVASVGVGIIDSKTGNVIHANSRLFSAANAENNAERRGFRGARRLTRRKKHRVKRVRDLFEKYDISTDFRNLNLNPYELRVKGLTEQLTNEELFAALRTIAKRRGISYLDDAEDDSTGSSDYAKSIDENRRLLKTKTPGQIQLERLEKYGQLRGNFTVYDENGEAHRLINVFSTSDYKNEARKILETQSNYNKQITDEFIEDYIEILTQKRKYYHGPGNEKSRTDYGRFRTDGTTLENIFGILIGKCSFYPEEYRASKASYTAQEFNFLNDLNNLKVPTETGKLSTEQKEYLVDFAKKSKALGASKLLKEIAKIVDCSVDDIKGYRVDNKDKPDLHTFEPYRKLKFNLSSIDIDELSRETLDKLADILTLNTEREGIEDAIKRNLPSQFTEEQISEIVQIRKNQSSAFNKGWHSFSAKLMNELIPELYVTSEEQMTILTRLEKFKVNKKSSKNTKTIDEKEITDEIYNPVVAKSVRQTIKIINAAVKKYGDFDKIVIEMPRDKNAEDEKKFIDKKQKENKKEKDDSLKRAAFLYNGTDNLPDGVFHGNKELKTKIRLWYQQGERCLYSGKLISIHDLVHNSNKFEIDHILPLSLSFDDSLANKVLVYAWTNQEKGQKTPYQVIDSMDTAWSFREMKDYVLKQKGLGKKKCEYLLTTENIDKIEVKKKFIERNLVDTRYASRVVLNSLQTALKELGKDTKVSVVRGQFTSQLRRKWNIDKSRETYHHHAVDALIIAASSQLKLWQKQENPMFESYGENQVVNKETGEILSISDDKYKELVFQPPYQGFVNTISSKGFEDEILFSYQVDSKFNRKVSDATIYSTRKAKLGKDKKDETYVLGKIKDIYSQDGFDTFIKRYKKDKTQFLMYQKDPLTWENVIEVILRDYPSEKLSEDGKKTVKCNPFEEYRRENGLICKYSKKGNGTPIKSLKYYDKKLGNCIDITPEKSKNRVVLRQISPWRADIYFNLETLKYELMGLKYSDLSFEKGTGKYHISQEKYDAIREKEGIGKKSEFKFTLYRNDLILIKDTLNNCERMLRFGSKNDTSKHYVELKPLEKGTFDSEEEILPVLGKVAKSGQFIKGLNKPNISIYKVRTDVLGNKFFIKKEGDKPKLDFKNNNK

SEQ ID NO: 280 - protein, 1125 aa, Streptococcus intermedius B196
MNGLVLGLDIGIASVGVGILNKETGEIIHVNSRIFPAATADSNVERRGFRQGRRLGRRKKHRSARLNDLFEEFGFITDFSAVPLNLNPYALRVKGLSEELTNEELFIALKNIIKRRGISYLDDASEDGETASNEYGKAVEENRKLLADKTPGQIQLERFEKYGQVRGDFTVVENGENHRLINVFSTSAYKKEAERILRRQQEFNVRISDEFIEAYLTILTGKRKYYHGPGNEKSRTDYGRFRTDGTTLDNIFGILIGKCTFYPDEYRAAKASYTAQEFNLLNDLNNLTVPTETKKLRPEQKRQIVEYARTAKTLGTPTLLKYIAKLVDGSIDDIKGYRIDKSDKPEMHTFDAYRKMRTLELVDVDILSRETLDDLAYILTLNTESEGILEALNSKMPGTFTKEQIDELIQFRKKNSAVFGKGWHNFSLKLMNELIPELYETSEEQMTILTRLGKQRSREISKRTKYIDEKELTDEIYNPVVAKSVRQAIKIINLATKKYGIFDNIVIEMARESNEDDEKKAIQNVQKANEDEKKAAMEKAADLYNGKKELPDSIFHGHKELATKIRLWHQQGERCLYTGKNISIHDLIHNPHQYEIDHILPLSLSFDDGLANKVLVLATANQEKGQRTPFQALDSMDDAWSYIEFKQYVRNSKSLSNKKKDYLLTEEDISKIEVKQKFIERNLVDTRYSSRVVLNTLQEFYKTNDFDTKISVVRGQFTSQLRRKWKIEKSRDTYHHHAVDALIIAASSQLRLWKKQNNPLISYREGQLVDPETGEILSLTDDEYKELVLRPPYDYFVDTLKSKSFEDSILFSYQVDSKYNRKISDATIYGTRKAQLGKDKQEETYVLGKIKDIYSQKGYEDFIKRYKKDTTQFLMYHKDPQTFAKVIEEILKTYPDKELNEKGKEIPCNPFEKYRQENGPIRKYSKKGKGPEIKSLKYYDNKLGNHIDITPVNSQNQVVLQSLKPWRTDVYFNPQTSKYELMGLKYSDLRFEKGSGSYGISPEKYNKVKAKEGVDEDSEFKFTLYKNDLILIKDTETGEQQLFRYGSRNDTSKHYVELKPYEKAKFEGNQQLMNLLGTVAKGGQCLKGINKPNLSIYKVKTDVLGNKYFIKKEGDQPQLNFKKKI

SEQ ID NO: 281 - protein, 1373 aa, Streptococcus lutetiensis 033
MEKTYSIGLDIGTNSVGWSVITDDYKVPAKKMKVLGNTDKKYIKKNLLGALLFDSGETAEVTRLKRTARRRYTRRKNRLRYLQEIFAKEMAKVDESFFQRLEESFLTDDDKTFDSHPIFGNKAEEDAYHQEFPTIYHLRKHLADSSEKADLRLVYLALAHMIKFRGHFLIEGELNAENTDIQKLFNDFVETYDKIADESHLSEVDASSILTNKISKSRRLENLIKQYPTEKKNTLFGNLVALVLGLQPNFKTNFKLSEDAKLQFSKDTYDEDLEELLGKIGDDYADLFTAAKNLYDAILLSGILTVDDNSTKAPLSASMIKRYEEHHEDLEKLKKFIKVNNFDKYHEIFKDKSKNGYAGYIENGVKQDIFYKHLKSIISEKNGGQYFLDKIEREDFLRKQRTFDNGSIPHQIHLQEMRAILRRQGEYYPFLKENQAKIEKILTFRIPYYVGPLARKDSRFAWANYHSDEPITPWNFDEVVDKEKSAEKFITRMTLNDLYLPEEKVLPKHSHVYETFTVYNELTKIKYVNEQGESFFFDANMKQEIFDHVFKENRKVTKAKLLSYLNNEFEEFRINDLIGLDKDSKSFNASLGTYHDLKKILDKSFLDDKTNEQIIEDIVLTLTLFEDRDMIHERLQKYSDFFTSQQLKKLERRHYTGWGRLSYKLINGIRNKENNKTILDFLIDDGHANRNFMQLINDESLSFKTIIQEAQVVGDVDDIEAVVHDLPGSPAIKKGILQSVKIVDELVKVMGDNPDNIVIEMARENQTTNRERSQSQQRLKKLQNSLKELGSNILNEEKPSYIEDKVENSHLQNDQLFLYYIQNGKDMYTGDELDIDHLSDYDIDHIIPQAFIKDNSIDNRVLTSSAKNRGKSDDVPSLDIVRARKAEWVRLYKSGLISKRKFDNLTKAERGGLTEADKAGFIKRQLVETRQITKHVAQILDARFNTKRDENDKVIRDVKVITLKSNLVSQFRKEFKFYKVREINDYHHAHDAYLNAVVGTALLKKYPKLTPEFVYGEYKKYDVRKLIAKSSDDYSEMGKATAKYFFYSNLMNFFKTEVKYADGRVFERPDIETNADGEVVWNKQKDFDIVRKVLSYPQVNIVKKVEEQTVGQNGGLFDNNILAKPEKDDKKKLFPIKKSLSTTSYGGYARATIAYSILIVSEFGKNKELKLLGLPLLDKVKYEKNPIAYLNSIGIINVKSIFKLPKYCLFEFQEKNTNYRRYMVSNQELKRANQLFLTCKETELVYKYIKSDNDNTHLVGNEKTILSIWNKLVIFMERTKLIDKKLFASLKQLKDEVDLINILDMTAKSLDFTKISAGQKKITISDSLSLPIKRWQFSSDEKMLKQLKTATLIHQSVTGLYETRIDLSKLGEE

SEQ ID NO: 282 - protein, 1392 aa, Streptococcus mitis SK321
MNNNNYSIGLDIGTNSVGWAVITDDYKVPSKKMKVLGNTDKHFIKKNLIGALLFDEGATAEDRRFKRTARRRYTRRKNRLRYLQEIFSEEMSKVDSSFFHRLDDSFLVPEDKRGSKYPIFATLAEEKEYHKKFPTIYHLRKHLADSKEKTDLRLIYLALAHMIKYRGHFLYEESFDIKNNDIQKIFSEFISIYDNTFEGSSLSGQNAQVEAIFTDKISKSAKRERILKLFAYEKSTDLFSEFLKLIVGNQADFKKHFDLEEKAPLQFSKDTYDEDLENLLGQIGDDFADLFLVAKKLYDAILLSGILTVTDSSTKAPLSASMIERYENHQKDLAALKQFIQNNLQEKYDEVFSDQSKDGYARYINGKTTQEAFYKYIKNLLSKFEGSDYFLDKIEREDFLRKQRTFDNGSIPHQIHLQEMNAIIRRQGEHYPFLKEYKEKIETILTFRIPYYVGPLARGNRNFAWLTRNSDQAIRPWNFEEIVDQASSAEEFINKMTNYDLYLPEEKVLPKHSLLYETFAVYNELTKVKFISEGLRDYQFLDSGQKKQIVNQLFKEKRKVTEKDIIQYLHNVDGYDGIELKGIEKQFNASLSTYHDLLKIIKDKEFMDDPKNEEILENIVHTLTIFEDREMIKQRLAQYASIFDKKVIKALTRRHYTGWGKLSAKLINGICDKKTGKTILDYLIDDGYSNRNFMQLINDDGLSFKDIIQKAQVVGKTNDVKQVVQELPGSPAIKKGILQSIKLVDELVKVMGHAPESIVIEIARENQTTARGKKNSQQRYKRIEDALKNLAPGLDSNILKEHPTDNIQLQNDRLFLYYLQNGKDMYTGEALDINQLSSYDIDHIVPQAFIKDDSLDNRVLTSSKDNRGKSDNVPSLEVVQKRKAFWQQLLDSKLISEHKFNNLTKAERGGLDERDKVGFIRRQLVETRQITKHVAQILDARFNTEVNEKDKKNRTVKIITLKSNLVSNFRKEFKLYKVREINDYHHAHDAYLNAVVAKAILKKYPKLEPGFVYGDYQKYDIKRYISRSKDPKEVEKATEKYFFYSNLLNFFKEEVHYADGTIVKRENIEYSKDTGEIAWNKEKDFATIKKVLSLPQVNIVKKTEIQTHGLDRGKPRGLFNSNPSPKPSEDRKENLVPIKQGLDPRKYGGYAGISNSYAVLVKAIIEKGAKKQQKTVLEFQGISILDKINFEKNKENYLLEKGYIKILSTITLPKYSLFEFPDGTRRRLASILSTNNKRGEIHKGNELVIPEKYTTLLYHAKNINKTLEPEHLEYVEKHRNDFAKLLEYVLNFNDKYVGALKNGERIRQAFIDWETVDIEKLCFSFIGPRNSKNAGLFELTSQGSASDFEFLGVKIPRYRDYTPSSLLNATLIHQSITGLYETRIDLSKLGED

SEQ ID NO: 283 - protein, 1345 aa, Streptococcus mutans TA 159
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 284 - protein, 1129 aa, Streptococcus orisratti DSM 15617
MTNGKILGLDIGIASVGVGVIEADTGKVVHASSRLFPSANADNNAERRGFRGGRRLIRRKKHRMKRVKDLFEEYKLETRFNNLNLNPYELRVRGLTEKLAPEELFAALKNLSKHRGISYLDDAEDDNASAKTNYAKSVLANKELLKTRTPGQIQWERFEKYGQIRGDFDIVTPEGEQQRIINVFSTTDYKKEAEQILETQALYYPQISSEFIEDFITILTSKRKYYHGPGNEKSRTDYGRYRTDGTTLDNIFDILVGKCGIYPDEYRAAKASYTAQEFNFLNDLNNLTLPTETKRLSTDQKKDLVRFATTAATLGPDKLLKEIARMVGCSKDDIKGYRIDNKEKPDLHTFEAYRAMTKLNTFDVATFSREMIDELARILTLNTDREGIEEAIVNDFPNLFSREQIDELIQFRKSKSQLFGKGWHSFSLKLMSELIPELYATSEEQMTILTRLNKMSPERKVTLRTKYINEQDATEEIYNPVVAKSVRQAIKIINECIKKWGEFDQIVIEMPRDKNEDDEKKRIADGQKANAKEKASATEFAASLYNGKKELPDEVFHGHKQLATKIRLWYQQDGKCLYTGQDISIHDLIHNQNQYEIDHIMPLSLSFDDSLSNKVLVLATANQEKGQQTPYQAIPKMKSAWSYREFKAFVLDCKRLSKKKREYLLTEEDIDKIEVRRKFIARNLVDTRYASRVVLTTLQDALEVMNKETKVSVVRGQFTSQLRRQWKIDKTRDTYHHHAIDALIIAASSQLKLWKKQDNPMFEEYEQGQKINLETGEILSDDDYKKLVFQSPYQGFVHTISSKSFEDEILFSYQIDSKVNRKISDATIYATRQAQLSRDRKKETYVLGKIKDIYSQTGYDAFRKRYDKDKTVFLMYQKDPLTWEKVIEVILRDYKEFDDKGKEVGNPFERYRQQNGLMTKYSRKNKGTPIKALKYYDNKLGNHVDVTPDDSKNPVVLQSINPWRADLYFNPKTAKYELLGLKYADLSFEKGTGNYTISQEKYDEIKKREGISAESEFKFTLYKNDLLLIKDIENGEEQVFRFLSRTMPNQKHYVELKPYDKAKFDGGQSLLTVLGTVAKGGQCLKSLNKVGISIYKVKTDVLGYQHFIKKEGNQPKLSFENSIKRHKNK

SEQ ID NO: 285 - protein, 1140 aa, Streptococcus parasanguinis F0449
MNGLVLGLDIGIASVGVGILKKDIGEIIHTNSRLFSAATADSNIERRGHRGGKRLTRRKKHRSIRLHDLFEDFGLLTDFSKVSINLNPYQLRVQGLDNQLTNEELFIALKNIVKRRGISYLDDASEDGGTVSSDYGKAVEENRKLLAEQTPGQIQLDRFEKYGQVRGDFNVVENGEKRRLINVFTTSAYSKEAERILRKQQEFNKKITDEFIEDYLTILTGKRKYYHGPGNEKSRTDYGRYTTKKDPEGKYITLDNIFGILIGKCTFYPDEYRASKASYTAQEFNLLNDLNNLTVPTETKKLSEEQKKTIIKYAKTAKTLGASTLLKYIAKLIGASVDQIHGYRIDPNKKPEMHTFETYRKMQSLETISVEELPRKVLDELAHILTLNTEREGIEEAINATLKDTFSQDQVLELVQFRKNNSSLFSKGWHSFSLKLMMELIPELYETSEEQMTILTRLGKQKSKETSKRTKYIDEKELTEEIYNPVVAKSVRQAIKIINEATKKYGIFDNIVIEMARENNEEDAKKEYIKRQKANLDEKNAAMEKAAFQYNGKKELPDNVFHGHKELATKIRLWHQQGEKCLYTGKNIPISDLIQNQYKYEIDHILPLSLSFDDSLSNKVLVLATANQEKGQRTPFQALDSMDDAWSYREFKSYVKDSKLLGNKKKEYLLTEEDISKIEVKQKFIERNLVDTRYSSRVVLNALQDFYKEHQFDTTISVVRGQFTSQLRRKWGLEKSRETYHHHAVDALIIAASSQLRLWKKQNNPLISYTEGQFVDQVTGEIISLSDDEYKELVFKAPYDHFVDTLKSKKFEDSILFSYQVDSKYNRKISDATIYATRKAKLDKENKEYTYTLGKIKDIYALGTKSPSKTGFYKFLDLYNKDKSQFLMFQKDRKTWDEVIEKIIEQYRPFKEYDENGKEVDFNPFEKYRIENGPIRKYSKKGNGPEIKSLKYYDNLLGKFVDITPSESKNPVALLSLNPWRTDVYYNTETSKYEFLGLKYADLCFEKGGAYGISEVKYNKIREKEGIGKESEFKFTLYKNDLILIKDTETNCQQIFRFWSRTGKDNPKSFEKHKIELKPYEKARFEKGEELEVLGKVPPSSNQLQKNMQIENLSIYKVKTDVLGNKHFIKKEGEEPKLKF

SEQ ID NO: 286 - protein, 1385 aa, Streptococcus salivarius K12
MTKPYSIGLDIGTNSVGWAVITDDYKVPSKKMKVLGNTSKKYIKKNLLGALLFDSGITAEGRRLKRTARRRYTRRRNRILYLQEIFSTEMATLDDAFFQRLDDSFLVPDDKRDSKYPIFGNLVEEKVYHDEFPTIYHLRKHLADSSKKADLRLVYLALAHMIKYRGHFLIEGDFNSKNNDLQKNFQDFLDTYNAIFESDLSLENSKQLEEIVKDKISKSAKKDRILKLFPGEKNSGIFSEFLKLIVGNQADFRKYFNLDEKTSLQFSKESYDEDLETLLGHIGDDYSDVFLKAKKLYDAILLSGILTVTDNGTEAPLSSAMIMRYKEHEEDLALLKAYIRNISLETYNEVFKDNTKNGYAGYIDGKTSQEDFYVYLKRLLAGLEGADYFLEKIDREDFLRKQRTFDNGSIPYQIYLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYENFTVYNELTKVRFIAEGMRDYQFLDSKQKKDIVRLYFKGKRKVTDKDIIEYLHAIDGYDGIELKGIEKQFNSSLSTYHDLLNIINDKEFLDDSSNETIIEEIIHTLTMFEDREMIKQRLSKFDNIFDKSVLKKLSRRHYTGWGKLSAKLINGIRDEKSGNTILDYLIDDGVSNRNFMQLIHDDALSFKKKIKKAQIIGDKDNIKQVVKSLPGSPAIKKGILQSIKIVDELVKVMGREPESIVVEMARENQYTNQGKSNSQQRLKRLEESLKGLGSKILKENVPTRLSKIDNNALQNDRLYLYYLQNGKDMYTGEELDIDRLSNYDIDHIIPQAFLKDDSIDNKVLVSSASNRGKSDDVPSLEVVKKRKTLWYQLLKSKLISQRKFDNLTKAERGGLSQEEKAGFIQRQLVETRQITKHVARLLDERFNNKKDENNRTLRTVKIITLKSSLVSQFRKDFELYKVREINDFHHAHDAYLNAVVASALLKKYPKLEPEFVYGDYPKYNSFRERKSATEKVYFYSNIMNIFKKSIPLADGTVIDRPLIEVNEETGESVWNKVADLNTVRKVLSYSQVNIVKKVEEQNHGLDRGKPKGLFNANLSSKPKPNSKENLVGAKEYLDPKKYGGYAGISNSFAILVKGTIEKGAKKKITNVLEFQGISILDRIYYRKDKLNFLLEKGYKDIELIIELPKYSLFELSDGSRRMLASILSTNNKRGEIHKGNQIFISQKFVKLLYHAKRISSTFNENHRKYVENHKKEFEELFYYILEFNENYVGAKKNGELLKSAFQSWQNHSIDELCSSFIGPTGSERKGLFELTSRGGAADFEFLGVKIPRYRDYTPSSLLKDATLIHQSVTGLYETRIDLGKLGED

SEQ ID NO: 287 - protein, 1392 aa, Streptococcus sanguinis SK330
MENKNYSIGLDIGTNSVGWAVITDDYKVPSKKMKVFGNTDKHFIKKNLIGALLFDEGATAEDRRLKRTARRRYTRRKNRLRYLQEIFSEEISKLDSSFFHRLDDSFLVPKDKRGSKYPIFATLEEEKEYHKKFPTIYHLRKHLADSKEKTDLRLIYLALAHMIKYRGHFLYEESFDIKNNDIQKIFNEFISIYDNTFEGSSLSGQNAQVEAIFTDKISKSAKRERVLKLFSDEKSTSLFSEFLKLIVGNQADFKKHFDLEEKAPLQFSKDTYDEDLENLLGQIGDGFTDLFLVAKKLYDAILLSGILTVTDPSTKAPLSASMIERYESHQKDLAALKQFIKNNLPKRYNEVFSDQSKDGYAGYIDGKTTQEAFYKYIKNLLSKFEGADYFLDKIEREDFLRKQRTFDNGSIPHQIHLQEMNAILRRQGEHYPFLKENREKIEKILTFRIPYYVGPLARGNRDFAWLTRNSDQAIRPWNFEEIVDKASSAEEFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLAQYDSIFDEKVIKALTRRHYTGWGKLSAKLINGICDKQTGDTILDYLIDDGKINRNFMQLINDDGLSFKEIIQKAQVVGKTDDVKQVVQELPGSPAIKKGILQSIKIVDELVKVMGYAPESIVIEMARENQTTARGKKNSQQRYKRIEDSLKNLAPGLDSNILKENPTDNIQLQNDRLFLYYLQNGKDMYTGKPLDIDQLSSYDIDHIIPQAFIKDDSIDNRVLTSSKDNRGKSDNVPSLEVVQKRKAFWQQLLDSKLISERKFNNLTKAERGGLDERDKVGFIRRQLVETRQITKHVAQILDASFNTEVNEKNQKIRTVKIITLKSNLVSNFRKEFELYKVREINDYHHAHDAYLNAVVAKAILKKYPKLEPEFVYGDYQKYDLKRYISRFKPSKEIEKATEKYFFYSNLLNFFKEEVHYADGIIVKRENIEYSKDTGEIAWNKEKDFATIKKVLSYPQVNIVKKTEIQTHGLDRGKPKGLFNSNPSPKPSEDSKENLVPIKQGLDPRKYGGYAGISNSYAVLVKAIVEKGAKKQQKTILEFQGISILDKINFENNKENYLLKKRYIEILSTITLPKYSLFEFPDGTRRRLASILSTNNKRGEIHKGNELVLPGKYTTLLYHAKNINKKLEPEHLEYVEKHRNDFAKLLECVLNFNDKYVGALKNGERIRQAFTDWETVDIEKLCFSFIGPENSKNAGLFELTSQGSASDFEFLGVKIPRYRDYAPSSLLKATLIHQSITGLYETRIDLSKLGED

SEQ ID NO: 288 - protein, 1128 aa, Streptococcus vestibularis ATCC 49124
MSDLVLGLDIGIGSVGVGILNKVTGEIIHKNSRIFPAAQAENNVERRTNRQGRRLTRRKKHRRVRLNHLFEESGLITDFTKVSINLNPYQLRVKGLIDELSNEELFIALKNMVKHRGISYLDDASDDGNSSVGDYAQIVKENSKQLETKTPGQIQLERYQKYGQLRGDFTVEEDGKKHRLINVFPTSAYRSEALRILQTQKEFNPQITDEFINRYLEILTGKRKYYHGPGNEKSRTDYGRYTTKKDSENEYITLDNIFGILIGKCTFYPEEYRAAKASYTAQEFNLLNDLNNLTVPTETKKLSEEQKNQIINYVKNEKAMGPAKLFKYIAKLLSCDVADIKGYRIDKSDKAEIHTFEAYRKMKTLETIDFEKMSRDQLDKLAYVLTLNTEREGIQEALDHEFADGNFSQEQIDELVQFRKANSSIFGKGWHNFSVKLMMELIPELYATSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGRAELPHSVFHGHKQLATKIRLWHQQGERCLYTGKTISIHDLINNPNQFEIDHILPLSITFDDSLANKVLVYATANQEKGQRTPYQALDSMDDAWSFRELKAFVRESKSLSNKKKEYLLTEEDISRFDVRKKFIERNLVDTRYASRVVLNALQEHFRAHKTDTKVSVVRGQFTSQLRRHWGIEKTRDTYHHHAVDALIIAASSQLNLWKKQKNTLVNYSENQLLDIETGELISDDEYKESVFKAPYQHFVDTLKSKEFEDSILFSYQVDSKFNRKISDATIYATRQAKVGKDKKDETYVLGKIKDIYSQTGYDAFIKIYQKDKSKFLMYRHDPQTFEKVIEPILENYPNKEMNEKGKEVPCNPFLKYKEEHGDYIRKYSKKGNGPEIKSLKYYDSKLGNHIDITPKDSNNKVVLQSVSPWRADVYFNKTTGKYEILGLKYADLQFEKGTGTYKISQEKYNVIKKKEGVDSDSEFKFTLYKNDLLLIKDTETKEQQLFRFLSRTKPNVKHYVELKPYDKQKFEGNESLINVLGAVAKGGQCQKGINKPNISIYKVRTDVLGNQHIIKNEGDKPKLDF

SEQ ID NO: 289 - protein, 1366 aa, Lactobacillus composti DSM 18527
MTKDYSLGLDIGTGSVGFAALDTNYRLLRAKGNNVIGVRLFTPAETAEERRGFRTARRRLSRRRWRLGALNGIFAPELAKVDPNFLHRLKYAWVHPADQQNKGKYSAAPLFNDAALDRQFHDDYPTIYHLRLKLMTDTSQHDLREVYLAIHHIIKFRGNFLRGEGPINASEAFDINTFIDQMTAFYDQAFPDFKIVDQVDQQIIFKGLTDMTLSPADRANKALMGFNNAAQQPNKRIFKAILSGLVGNQVDLMAIFQLDGIPKEDQKEFKFKFVDNDIEEKLAALGDNPALSDEQNEFLTTLYAAFSGLTLKGLLGDATSISAAMVARYASHRTDWTYIKDHVLTPQNNRELRLAYADLMTDNEDVRLKAGKKFAKAIEAADIPAAKKSEFSLKIDNNEFLPRQRTKANGTIPHQLHLNELQQIIENQGQYYPFLKATFEQDGHTLNKIEGLVKFRVPYYVGPLVPKHKVAGNNANHWMVPKEPGAITPWNYTEKVDRDKSGNEFIRRMTGTDTYLLGEPTLPKNSLVYQEFNVLQELNNLRIEKRRLDIAVKQDIFEHVFKTNKTVTVKRIEEYLTTEFGSPVTLSGFANVNERKLNSSLSTYHYFVGIFGAEFVDDPKNLTLLEQIVELQTVFEDRKALQRQLKLRPELSEKQVKQLARTHYTGWGRLSQKLLTSKIVHVALEGEREPGQYSILETLYGTQMNFMEIVNDMKDRYGVKSWLDQENSGSENNLSLKQRILDMPGPKNIKRGINQAFHIIDEITRAVGNAPSRIYIEFARESQQSNLTNARVNRLKQLYSNQALKKEFAKLASEIKDLTKEQLKDDRLYLYYLQQGKDMYTETDIDITKISSNYQIDHIIPQAYTKNNSLDNRVLVNSEMNARKSDSPTFLPSLIQERKAWWRQLRDTGLMSTIKYNNLTRTSDDFSADQKERFIARSLVETRQVIKNVATLIKEYYDDSQVEALPSEITAEMRRYLNVRKNRDINDYHHAHDALLFATAGEFSRKVGIMEKGRVSDGAGNIYNRYTKDIIQRARAKAGQDKKVRPFTFIVGSMANPDTKFQTNQTTGEIVWTPEDVAYLRKVIDYKKMLVTKMTLDQTGTLYNETRYGSGDKHVAVALSKDKAADLYGGFGSLKPAYAALVYSKKKFRLVNVLRLWLPEIKKNASVLERKVQSVLGDDNAKVIRAHVPCGQLLIKDGALVTVSSATELHNFRQLWLPKADYQDISILLGAPDKVTAENRLQAESHFDDVDQRFESLLKDVIDQARQYYPLKTHQTSLEKLIGKIGKFDELKFAQKQQVFSRLLSALHANATNSDLKQIGLSTAWGRLIYPKGVSLTDEDKLINSSFTGLFNDVMSIKEFHDFSIN

SEQ ID NO: 290 - protein, 1366 aa, Lactobacillus concavus DSM 17758
MDKKYNIGLDIGTSSIGFVATDEDNHVIRAKGKNVIGVRLFDEGQSAAERRGFRTTRRRLNRRKWRLNLLREIFEPHIYPIDASFFMRQKYSNLSKQDPNQKIEFKDILFSDKSDAEFYRQYPTIYHLRQALMTEKRQFDLREIYLAIHHIVKYRGHFLDETPTDKFSFDQLDLTQEFERLNVLFSEQNPEEPFEIVVNQNQSIEDILSNQSMTASDRRKQALVVFYQQSENKENEKQYKAIATEILNLLLGNKAKLNVILAQEVDKEAAKDWSLSLSSETFDDDLEKASSGLNDSQLEMVGIFERIYSSLILKSIIGDHNSLSAAMVDKFKTHAQHRDLLKDVIKNSDATKGEQLQFAYDHYLQRHSADGKAYGKDDFYKEVKKNLDDSDAAQQIQQLIDTDQFMPKQRTKANGAIPHQVQQKELDLIIENQCQYYPWLAEENPNSERHNVAKYKLDELVSFRVPYYVGPLISPADDETDPQAIQNTKFAWMIRKDAQGRITPWNFDDKVDREKSADKFIKRMTTTDTYLIGEDVLPDQSLIYQRYKVLNELNNVRINGRPIEVQIKQNIYTDLFKKFKSVSVKKLRSYLEEMSYYPGSFKISGLTNPGKFDNGLTSYLDYKNILGDSVDANDKRADIEQMIEWSTIFEDNKIFAQKLESMTWLTAEQRKAISRKRYTGWGRLSNKLLTQLKNQDNRSIMDLLWETEENFMKIQSAPDFSKMIEAHNQQFIKNEANIQQVISDLYTSPQNKKAIRQILLVVDDIQKAVGHAPEHIAIEFAKGEDKNPRRTISREMKIQDVYQQISDDILVSPEVRAQLNEKIENRHGRLSDRLFLYFMQGGRDMYTGKPININNISHYDIDHILPQAFIKDDSLDNRVLVSDKLNREKSDTVPRDLFGREMMSTWEKMADRGLITKRKLANLKTIPGSIDAHKAQGFINRQLVETRQVIKLAVGIMIDQYPETQIVSVKANLTHEMREMFDLVKNRDVNDYHHAFDAYLTAFVGNYLLQRYPKLEPYFVYDKFKKLKDQNISMRDFNLLYDLKKNEDVYDQRTGHSAHKIWDQHGSIDYIRHLFAYKKILVSHEVHQNGGALYNMTVYGKADDAKRKLIPIKADKPTELYGGYTSRKLAYMAIVKTKKGKKEQYQVTGVPVSALTTLRQFKEDSPEQKQALEEIVRRNFDEKTEVEIIVPKVLFNQLIVDEKCRFMVGSDTYRYNAQQLVLSADDLEIINASHKDIQTIDSSDYSQQLDQVYQNILTIVDKHFPMYDINKFRTKLHDIYEQYIELPNEDVWENNKLTTLGKHTIIIRILQGLHANATVVDLKQLGIKTPFGFMQQARGIVVSPDAQLIYQSPTGLYERRVRLGDL

SEQ ID NO: 291 - protein, 1319 aa, Weissella halotolerans DSM 20190
MAYSVGLDIGVGSVGFAGIDNQYNLVRTKGKNVIGVRLFDEADSAAERRGHRTNRRRLQRRRWRLRLLDDIFAKPLQAVDPNFLARLKYSYVNKKDQGQQDHYYGGYVFGSTAADQAYHQAYPTIYHLRKRLMEDDQKHDLREVYLAIHHIVKYRGNFLNPQSSLDIDQQFDVTDFAQALARFADHQALSWALEAPIRFLEAELATGLSNSARVDAAIEAFSFDTKVDRAAIKEMLKGLSGNQIDFTKLFVNVDSADWDQEERKQWKMKLSEEDFDEQALPILERLSQDETEFFLAIKRAYDGIALMRFLGDEQSLSSAMIKAYEDHRRDLTFLKTQVRTPQNRQALSEGYTNYLSVDDKKHKRGAKELAQLIEASDASEQDKATMLDRIANDQFAPKQRTKANGLIPYQLHLAELKKILAKQGQYYPFLLDTFAKQGQSVNKIEELVQFRVPYYVGPMVPKSETAGNAENHWVEKNDGQTKVSVTPWNFDQVFNRDRAAKSFIDRLTGTDTYLIGEPTLPRHSLTYETFTVLNELNNIRIDGKRLPVETKQAIVEDLFKKYRLVTKKRLQDYFASFGKREVELTGLADESRFTSSLTSYHDLQGLLGTDFITNPQNHSLLEKIVEIQTVFEDSDIAERELGKLGLEQKLIPRLAKKHYTGWGNLSRKLLDTSFIHDPERPEEPVSIMDLLYTTNKNFMEILHDSEYGVEEWLKSQNMIDDQKDIQMRIDELTTSPANKRGIKQAFNVLDDITQAMGEEPAYVYLEFAREKQASRRTVSRKKRLETLYKNAALKTEFKAIKEALAEESDDRMQDDRLYLYYAQLGRDMYTGQSISIDQLSSHYDIDHIVPRAFIKDDSLENKVLVNRTDNARKTDSATFTADVKAKAFPLWQQLKKLGLISAKKFRLLTRTGDFTEMERERFIARQLVETRQIIKNVAALIEGHFSQTQAVAIRAEVTGELRQLTQIKKDRDINDYHHAQDALLVATAGTYLHRHFPKRDARFIYNEFDYYTQHWLKNQGENRRRHPYSFVVGTMSKGNEDWTPDNLNYLRKVMQYKTMLMTRKPVGPEGALYKETLIAADPKKRLVGASKERQDPTIYGGYTKESSAYMSLVRAGGKNQLVKIPVRIANEIHSGQRKLDDYVQAKVKKFERILLPKISLGQLVEDEGQRFYLATNEMKHNAKQLWLDQKVVTTYKRLTAESPVEDFLTVFDALTSSATIHHFKFYQRDLELLRDNRAGFQDLAKATQLKVLKDVLYELHDNAGWRDPIKQYFKEIGLKVRMWTKLQKEGGIKLTDQAELIYQSPSGLFEKRRRVQDLL

SEQ ID NO: 292 - protein, 1370 aa, Weissella kandleri DSM 20593
MEKNKEYVIGLDIGTGSVGWSAISTDNYQLIRQKGKNLIGVRLFNSAETAEERRGYRTTRRRLSRRRWRMSLLNDIFRPELNEIDENFLARLKYSWVSPLDQKNPQLNEQGTNASLYGDIEADQAFHRAYPTIYHLRKTLMEDNQKHDLREVYLAIHHIVKYRGHFLTPDFDANSQTIDIKGLFKQLGDVSGSIELQADQTSTVIAAFQSILLDFTKTPTESGRLAGQLFSDQNKDKQAKKQVEELFKLLRGGKGSLADMFLLTDLDKVVKNQLKFAFDDAVDENLNLISNLINEEQYELLLNIQKLRGTIILKQILGDDETVSDAKVRSYEEHAHQLKELKAQVLTKDNKEKFEEAYQLIQKGDASRIDGLKKLKTIINQEHEALRLDKYEADKLLKLIELDQLLPVQRSKRNGEIPHQLHEFELKKIIEKQGRYYPFLRETFERDGQEFNKIGQLVNFRIPYYVGPLVDPRLAGIQSGDQTNHWMTQKKAGKITPWNYTELIDIDKSAAEFIKRMTGTDTYLVGEPSLHKASLIYQDYNVLQELNNLRYDGKPLPVDAKQEIYSNLQVSLKNATKNKINSFLISEGYLQDGEELTGFAGKELKNKLSSFHYFKNIFGPERMNTLGTDNLEKITELQTVFEDRHMLKRQLQKLGFLDDDECEKLAGKHFTGWGNLSKKLLNTPAIIDPEINENKISLIDALYKGQRNLSFYVNNMDDKYQFRDWIESENQSQQVEISLDEKIKNLAGSPAIKRGITQSMAVIQDIIRANNGISPKRIYLEFARESQNSYQPNSRIKQIEKIYDQNKKELMKVYPDVFKDVQGVLNNVDENNSLSEKAFLYFMQLGKDMYTGEALDFDKLYTYDIDHIIPQAMTKDNSWDNKVLVTAIKNREKSNQVLDNAIQAKMHNFWLQLKKVNLLSQRKYDTLMKTNFSKGDEKKFIARSLVETRQIIKNVAELIKSEFDHVEAIPIRQELTSDMRQLMDYKKNRLVNDYHHAHDALLIATVGEFMQKRGFMQGMNPSQNVYHGYTQYVKKWLSMAKKARSAEKPERIFPLQFVVGSMRMAVRDGQVDKVTHPATGEICWTADNEAYLRKVLGYKNILVTRKVKNAGKLYQRVTVKPKGSGEAPVNHQKSDINIYGGVTSEQAAELVLIRIKAKNNAKNMVIKIPTAIANQVANKTTTYDAYVRSLNIPNYAGIILDQIPLGQLVFDERTSFYLASAEIKHNARQLWVNQHINNVLTKKNINDEERDNILNLLTNEKNLERFKLLEPDLKRVKAAKQQWASCDDQEQMQILRIIINKMHDDASPQIPGKIDPFKNYLDKQGKGWRDLRTKKGMKLSDNAEFVYQSPTGLYHRKISINELLKQKQLE

SEQ ID NO: 293 - protein, 1399 aa, Olsenella uli
MNLRNTTDEYNIGLDMGTNSVGWAVTDKAGAIAHFKGKPTLGSRLFDAAQTAAGARIHRSQRRRYVRRRWRLDLLQSLFQDEVSKVDSEFFCRLRQSRLYVGDREKGHADYTWPIFNDSDFNEVDYYKRFPTIYHLRKWLMETDEKADIRLIYLATHNIVKHRGNFLRENNKSLSSRDANPAQAVKSLRLALNDWCSERDYECAWKGEEDDGAIDEAILNVLADGEKGRSDQAKEIAKLTGVDCGDAKQSKQCNEAIAKAIVGLKVEMKNIFGEFPAEKTSYIYLSSDEDVEAVRESCPDDSGELFQALCKLYSAYILQELLSYADPSGQTISANMVAKYKQYGRDLRLLKELTRTYAPQKYDLFFRGETYAGSSDYVVDEARGYTRYNLGTTKANYDDFQKSVKELFKGTDALQDERYQEMMVAFGEQKFLRRLKTSDNGSIYYQLHLEELHTILENQGKHYPFLLSEEDKIESLVSFRIPYYVGPLTRKNAAIGHDGKERFAWSSRKDGMEHAVITPWNWEEIIDRDKSAEDFIMRMTGDCTYLQGEPVLPKCSLLYEEFCALNEFNGAHWTVDGDDERRFDAAQRERIMCDLFRRTRSVTYNKVSDWLERKYNFTGARVRGGQGEHGFESKLGSYIFFCKDVFKTDGLDEADYTMIEQIILWSTLFEDRDILKRKIEEAYGGDRLTSEQIKVICKKRFTGWGRLSKRLLTDIKVNTDTGRKSIMDVLREGNPNNGQRSRTMVFMEVLRDEDLGFQKAIDGLNRDYFREHNNGLMDVNDLPGSPAIRRSINQAVRIVDEIASIARKEPTNIFIEVTREEDDPRKKGKRTKRRYDAIKSALEKFKKDDPSLWKELCEKAPGDMDERLSLYFMQRGKCMYSGRPIKIEELHTGKYEVDHIIPRSYIKDDSFENKVLVYREENQHKTDALLIDSSIRQKMGGYWRMLHDAKLVGDKKFRNLFRNHIDDKAMKGFVARQIVETSQMVKLVQTLFEARYPNTRIVPVKAGISHDLREAAGLVKCREANDFHHAHDAFLACRIGLFIQKRHPSVYDNPIGLARIMRDYARMQAREYKKSHCLAHTQGFIVNSFLSSGFDEETGEIFKDDWDAKAEVEGIRRVLNCRQCFISRMPVEGDTRYGGRYWGETIYSPKGKHKHEIPLKQGLDPNLYGGYSDLLYSYFLIYEASDVSSGERVLRFIGIPTSIAARMANQKRLEEYVSRLALQENLEHVRMVRKIMKKQLIEVDNCRLLVTAADAVTNATELAFSLDEMKIISTCAKCINGADPSAIDKIGNAQDSFFDNLKRRGSDRCALLFSQLKLDKLSQNFYMISSDDKSKILISILDRIRAKSNSVDLSLVGGAKHAAQMKFDFNAKLNNPASSFVLIDQSVTGMFERRTRIGL

SEQ ID NO: 294 - DNA, 3720 bp, Bifidobacterium bombi
atgtctcagcacaggcgctatcgaatcggcatcgatgtaggattgaattccgttggtttggcggccgtcgagattgatgccaatcacgataatccattggatgagattcctatcagcattctgaatgcgcagtcagtgatccatgatggaggggtggatccagatgaggcaaaaagcgctacatcgcggagagcaagcgcaggagtcgcgcgtcgaacccgaaggttgcataaaagcaaacgtcaacgtctcgcaaaactcgacgaagtcctgaacgaactcggataccctgtcgaagacgagtcgcaattccctgccggatcaaacccctacatcgcttggcaggtgcgtgcgaagctcgcggagacattcattcccgatgttgaaactcgcaaaaggatgatatccatcgcaatacgccatatcgcccgacatcgtggttggcgaaacccgtacagctcagtagccgatgcggaacgtatgtcacatactccctcaccgttcatggtcgagtatgccaaaaaacttgatttcgaaataaatgacagaagaaccaatggcttttaccattctccttggcaaagtgtggatgaggaaggcaaaaggctatccaaatcagaattggaaaaacaaccaaaaatcgaagattggaacgacaatccaatcaatggaaagaccatagcccaattggtcgtctcttcgctagaaccgcaaaccaagatacgcagggacctgacacacggacttcaaactgaatcgacgttgaatattcagaccgagaaactgcatcagtcagactatattcacgaattagagaccattttcgagcgccagcacgttgatcagacgacgcaagaacaattactggaggccactttccataccaaaaatccaaaggcagttggagctgctgcaaaattggtaggaaaagatgcccttgactctcggtactatcgagccagtcgagcaactcccgctttcgaggaataccgggtcatggctgccatcgacaccttaagaatacgtgaacatggaacagaacgtcaactcacaacagacgaacgccgaaaactgtttgacttcatcaagggactgccttccaaaaaaacgaagaacgaaccttcaattagctctcttacttggggtgatgttgctgactttctcggaatacaacgaatcgacttgcgcgggttaggctctcttaaagacggagaaccggtgtcggcaaaacagccgccagtcatcgaaaccaacgacatcatgcagaaggcccctgaccctattgcagcttggtggtcacaggcgaacactaaagaacgagaccgtttcgtcgagttcatgtcaaacgcgggcgcaataaaagatacatcagatgaagttcgtaacatcgatgcggagatttcacaactgttggaagaactaacgggctcagagctcgaatccctcgacaagattacccttacttcaggaagagcagcatacagctctcagacgttacgcaacatcaccaactacatgtacgaaaccggctgtgatttaacaaccgcacgccaagagctctatcatgtcggcaagaactgggctcccccagctcccccaatctatgagcataccggcaatccatcggttgacagaacgttcagcatcattcatcgctggctatgcaatatgagagaccagtatggtgaaccagaaaccgtgaacatcgagtatgttcgagatggtttctccagcacgtccacacagctggctgaacagagggaacgcgataggaggtatgccgataaccttaagatgttgtctaactacgaaggagcaagttcacgctcagacgtccgccgcatcaaggcacttcaacgccagaattgccaatgcatttattgcggacgtaccataacgttcgagacctgccaaatggatcacgtattgcccagaaagggccctggatccgattccaagttcgaaaatctagttgccacatgcggcgaatgcaataaaagcaaaagcgataccctctacatgaattgggcgaaaacgtacccaaatactaatttgcaagacgtcctgagacgaattcaggagtggagcaaagatggttggatgaccgacaagcgctggagacaatataaggaagcgctgattctgagattggaagcaacggagaagcaagagccactggacaacagatccatggaatccgtctcatacatggcaagggaactgcgcaatcgcatttacggtttctacggttggcacgatcaagatgacgcactcaaacaaggcaggcaacgggtattcgtttcatcaggctcgatgaccgcagccgcacgaagaacgccatttgaaagccctctgatcaaaggcgcagacgaagagacgtatgaatcatcattgccctggcttgacggtatgaagggcaagacccgtctcgataggcgtcatcatgccgtcgatgcgagcatcatcgcgatgatgcgccctcagattgtaaaaatactgacagaagcacaggagattcgttctgagcagcacgacaagtacaggaaaggtcagacgccggactacgtgtgcaagcgtcgcgattattggcgcaattggagaggcacgccagacacgagagacgaagaggtcttcaactattgggctggcgagcagctaagaacgcttacggatcttgtgagccagaaaatggcggatgatgaaatacccgtcatctatccaacaaggctccgactgggcaatggaagcgcacacaaagataccgtcgtctccatgatgacaagaaaggtcggagacgaattaagcatcacggccattaataaagccgaatccggtgcgttgtacaccgcgctgacacgggattctgatttcgattggaagacgggtttgtcggcaaacccgaaccgtcgcatcagagttcacgataagtggtttgaagctgatgacaccatcaagttcctggaaccggctgttgaagtggtgctcaagaataacacgagagccagaatcgacccggaagcgcttgataaagttcacagtacgctttatgttccagtccgcggtggcatcgcagaggcaggaaattcaattcaccatgtacgcttctataaaattccaaaattgaattctaaaggcaaacaaacaggtagcatttatgccatgcttagggtgctgaccatcgatcttgctatgaaccagtacgataaagaaaccggcaaaaaacaagatctattcacacttccactcccggaatcctcattaagcagaagattcagcgagccgaagctacgtcaggcgttgattgacggcactgccgaatacttgggttgggctgttgtggatgatgaacttgaaatccctgcattcgcaaacgccaggataaccgaagaacaggccattaacggcagcttcacagataggttgctccattccttcccaggaacccataagttcagattcgctgggttcagtcgaaacacagaaatagcaatcagaccggttcagctggcatcagaaggattaatcgaaacagacgaaaaccgcaaaaggcaacaactacgactcactcaacccaatacagaatatagcaacagtattaaaaatgtcctaaagagtggcttacacttgaaagtcaacacgttattccaaaccgggattctcgttacccgtgccaactctcagggtaagcaaagtattcgattctcaacagtagaagaataa

SEQ ID NO: 295 - DNA, 3366 bp, Bifidobacterium dentium LMG 11045
atgtctgtgggattggccgcaattgaagtagacgaaacaggctttcccatcagaatcttgaacattcagagtgtaatccatgatggtgggatcgacccgcagctaggcaagaagaagtcgatatcccgcaaggccatttccggcgtcgctcgaaggacccggcgcatgcgcagaagaaaggtcgtgcgtcttcgtcagttggatgcgactcttgagagtttaggcttcccgattgtcgaaccggattccctagacacttgggagatttggctcacccgcgcgaaattggcgagttcttatattcaggatgacgagacccggaaagaggatgtctctattgcgttacggcatatcgcacggcatagagggtggaggaacccatattcgaacgtcgagtcgctgttcgtggacgtcgcaccttccgaacaatacgaagagcttagaagaaaggccgaggaaaagctcggcacgagtctgtccggcaacccgacttccgcggagatcgtcgaatgcatcttgaagagacaggttggtgaagtccagttgcgcaccagaagccgtaagggcgtgaatggcaatgcggtggaaaaagaaggactattgccgacgaagttgatgcagagtgacaacgccgcggaaattcgcaggatattcaaggtccagaggatagacgatgagacggggagaaaactgctcagggcggtcttcaaggcgtgctccccgaaagggtccgtggaacggagggtgggtagggacgccttggctcccggacttccccgtgctcttaaggcatcgttggcgttccaagagtatcggattgcaaatgtcctcacgaatctcgtcatttcagaagatgggacgaagagaaaactgacaatcgcggagaaacagcgtgtctttggttttctttcttccaatgagaccgatgacattacgtggattgatgtggccgaaaaattgggattggaaagaaggcagattcaaggcgtcggctgtctgaccgccgatggcgaagaaagaatctcctcgactccgccacgtaacatcaccgcgctgcacatccattcggcgaaaccggtaataagggaaaagctcgttgcgtggtggaaggctgcgtctcccacggtgcgggaaaccatggtagagctcctttcgaatacggtcgatattgaccgcgtccgcgaagacatggactactcgtcggcggtcgcgttcatcgattccttgggtgacgaggaactgactgcgctggattcggtggatctcctgtcgggacgtgctgcgtattcacgtcagacattgaagcagctgacggaaagaatgctgaatacagatgacgacctgcatgaggcccgcaaggcggtttttggcgttgacgacaattggaagccgccagtcgatgcaatcagcacgtcggtggggaatcccgccgttgaccgtgtcctgaaaatcgtgaacagatatctgttggcatgccagaaacggtggaggaatccccagagcgttcagatcgaacacgtgagggagagcttttcttccgtcgccaaagcgaaagagacggaaagggttcagggtgaaagagcacgataccgcaatgatctgaggcgagagctttgcgagcaggaaggacttaataagatacgtgaatctgacatcagacgttgggaatcggtccaaaggcagaatggaacgtgcctgtattgcgggtcaccgataacattcaggacctgtgagatggaccatattgttcccaggaaaggcgttggctcgaccaatacgcgggtcaatctcgcggccgcatgcgcggcatgcaacaagctaaaatccaatacagccttttccgtgtgggcgagaacggagggcgcggccaaccgtaaggtcagccagcgtgacgcaatcgaaagggttaagaccttcatctttaacaagtccgtgccaccaagagagcaacgcgcgttcaaacaggccgtaatctcaagactgagacaggccgagtcggatccggcaatagacaatcgctcgatcgaatcagtggcgtggatggccgatgagctgcatcgccgcattgaggcgtatttcaatcaggatgccgatgtgtcggggaatactccagccacccaagtgtgggtgttccaaggccgggtgactgcactggcccgtaaagccagcgggatcgaagggcgcatccatttcgcaggagagtggaaaaagacccgtctcgacaggcgacatcatgctgtcgatgccgctgtcatcgcgatgatgaaccattccgccgcgcaaaccctggttgaacgtgattcgcttcgcctctcgcaatggataaccaggaagccggaaacatggaagaactatcctttttcagaaggtcaaaagaaaacgcgtttcaaggaatggctcgactgcatgaatgcgcttctggaccttctgaatgacgcactcgactcggaccgtgttcccgtcacgcgttgccagaggatgtctctcggcaattcccaggcgcatgctgcgaccatcagaaaaatgaagcgtgtggaacttttctcgcctatggatgccgatttgatacgcagagcatccacgcccgcattatactgtgctttgacgagattgccggagtattctcccgagaagggtctgcccgagaatcgtggtcgtgagattgtgctcaacggcaggcatattcgatcaactgagacagtcgatttctttgcgagtggtgccgcccagctaatggtacgtaacggatccgccgaaatcggggattcgattcaccatatgaggatataccgttatcgaaagactggggcaaaatcgcaggaatacgtgtatgggatgatccgagtattccagattgaccttctccatgcgtcgtcggagaatctttttgcggtccagcttccgtcccagtcggtttccgtgagatacggggacaagaatgtggtccaagcgatacaagaggggcgtgcggagtatctcggccatatcgtccctaacgatgagatcctgattagctacgaaggcgtccggatgaaagacagcgagaaaatcggtgcatacgcgaatgatttcagtggtaccgcatccgagctcgcgcagcgacgacactgggtggttgtcggatctgatgtcagtaagttggccttacgtccctcttatctttccgaagaaggactagaaaacagcggatcggaatctgaacggctttcaaagcagacacggaaggtgatcgaaggcaaaggatgggtcgtcgcggttaatatactggccaaataccatcctgtcgtgataagacggaatgcgttgggcgagccaaggttccggaccaattccgggatgcctgtctcgtggcgctgggacaggtag

SEQ ID NO: 296 - DNA, 4173 bp, Bifidobacterium merycicum LMG 11341
atgagccggaagaatatcgttgaagattacgccatctcgctggatataggcaatgcttctgttggttgggtggcgttcactcctaattatcgtcttgttcgcgcgaaggggcacgaacttattggcgcaagactgttcgaacctgcttccacggcggaagagcgcagaatggcacgaaccactcgtagacgttactcccgtcgtcgttggcgtctacgtatgctcgattcgatgtttgaccaggcgttgtccgaggtggatccgtctttcctgatgcgaaggaagtattcttgggttcaccccgaagataagaataatgaagctcattggttcggtggcgtcctgtttgactcgaatgagcaggataaacgtttttacgagaaatacccgactatctaccatctgcgtaagagtctgatggaagatgatgagcgtcatgatatccgagaggtgtacctcgccatccatcacatgatgaaataccgtggcaatttcctcacggaaggggaattggccccttcttcggttttcgatgtcgaggattttctcaagttgctcacggaaattctgcaatatgctgatgaaggcgaaactgacgaggatctggagctgcaagcggatgcgaatgggctgacggaagcgctgtgcacgaccaaaggctctcgctccatacgtgctaagaatgcaatctccattctcaaggaaggtgccgcattatcgaagcgccaagaggctatcattagcgcagtgtttgccggtcttgaaggcaacaagcttgatttgacgaaggtgtttcctaataaggaatacactccggaagacaagaaaacgctcgcgctctatttcaacaaggccgattatgacgagaagcgtgtcgcaatcggtgattctggtctgctggaagataatgaatgcgattttctggactgtattcggcgacagtacagtgccatcgctctgaaacagttgctgggagatttcacaagcatttctgagtcgatgtgcgcgagatatgaacagcatcaacggaattgggacttgatcaagcgctattgccgcgaggaatccaatgcagaaaatatcaacaagaactacggcgctctcgtaggctgggaaatcgttggaggacagcgaagaagcattcgcggtgcaaaggattatgagaacaagcgcaaagcagccaacaagttctttgaggagctgattaaaggttctgctttgcctgatcaggagaaagaaagacttctccacgacatcgaaaacgatgagttgttccctgtccaaagggactctggcaatggcgtgattccctaccagcttcatctgaacgagttgaagaaaatcatccaaaaacagggacggtattatcccttccttctggagacctatatcaaagatggtaaggaagtcaataagctagaaggtttgcttgctttccgcgtgccttattatgttggtccgctggtatcgcgtgatgacatgcagtcgtccgataatagggaaaaccattggatgattcgcaggaagaagggcgtgattacgccttggaactttgacgagatggtcgacaaggataagtcgggacacgaattcattaagagcttggtaggcacggacagttacctgcttggcgagacgacgttgccaaagaattccctgctgtaccaggaattcgaagttcttaacgagttgaacaatgtccgtctgtctattcgtacaggcaaccattgggctgataagcggcgcgtgagactcggccacaatgagaagaaactgttgcttgaagaactttttgccaaacaagcaacggtcaccaagaaggctgctgaaaatctgttgcgcagaacatatgggaacacctatgagatttccggcttggctgacgagaagaaattcgtcagctccctgtcttcgtatgggaagatgtgccgcacgctcaaagcctcctatgtgaatagtcataaggatgtcgttgagaagattattgagttgcagacggtgtttgaagataaaaagactttgaaacatcagctgcagctgcttggcgagctggcggaaaccaattgcgagctactctccaatacgcattacacaggatggggcaagctgtcaagaaagcttcttacctcgaaggtagttgtttgcaagatcgggaatgatttcgctcctgcaaaacacagcattatcgagataatgcgggaaaccgaccgtaatttcatggagatcatcaccgacaaggatcttggcgtcggggagtggattaaccagcagaacgttggcgccgaagatgggaactcctatcaggatataatcgatgacctgcgtgtttcgcctaaggtcaagagaggtattaatcaggcgattcgagtcattgatgatatctcgaaggcagtaggcaaggaaccgtcgcggattttcctggaactcgcgggagatgtccagcaaagcgcccgaacggtatctcgaaagagccgtttgcaggggttgtacaagagtgctggattgcagaaggagttccgggacctcgccgaatcattgaacgagtgcagtgataatgatttgcgagacgataggctgttcctgtactacacgcagcttggtaaagatatgtataccggagaacccctgaatcttgacaggctctcttcggattacgatatcgatcacatcatcccacaagccgtgactcagaatgattctctggataatcgagttttggtagctcgcgtggcaaacgcgagaaagacggactctttccagtatctgcccgaaatcgcgaaccgtatgaggaatttctggcaggagctgttggacgctggtctgattagtcgtgttaagttcgacagactgaaccgtcagaatgatttctcctcccacgagaaggagcgtttcgtccagcgctcgctggtggagactcgtcagattatgaagaacgtcgccaccatcatgcgtaagcgttatggaaacagcgctgcggtaatcggtttgaattccgagctaacgaaggagatgcgtcaatatcttggtttctctcataagaatcgtgacattaacgactatcaccatgcacaggatgcgctatgcctcggtattgcgggccagttcgccgttaataggggcttcttcgctaatggtatggtttccgatggggcagtgaattcctacaatctgtatctgcaggattacctgcgcggatacagggagaaaatgagtgctggggagcgcagaagaaataaagcgtttggctttattgttggttcgatgaattcccaggattcagacaagcgtatcaatcctaagacgggagagattgcttgggatgatgaagataaagtatatcttcgcaaggtgatgaattaccgtaagatgctcatcactcagaaggtgggtgatagctttggcgcgttgtataacgagacccgttacggaacttcagcgaaggaaggtgtcaatggcatccccttcgataagcacaagcaggatactgctttgtatggcggcttttcgagcgcgaagacggtctacgtcgttctgattgaagcgaagaagaaaacacgtctagtgaatatcacgatgcaggaatacgccgagttgggagatcatccttccgacgatgcactgagagcggttctggctaagaaaaagccggaatatgggaaggcgcgcattctgctacgtcacattcctccgatgcagctgattcgttatggtggggccttggttacggtcaagtctgccactgagctgaataatgctcagcagctatggcttccatataaggaatattgtctgttcgatgatgtgataagttctgcgatcgatgtggatgaagcgcggctttgccagatgcttgacgtgattttggatgccatacagaagtattacccgaagcagcgttttgacgagactggcttgtctgctttccacaatgctttcaacgaggtttctgcggaagacaagaagagaattgtcggggaaatggtaggaatgctgcatgctgatgcaaagaatgcgaacttgaaagctcttggaatgagtgggaggtggggacgcatgagtaatcagtcaggatatacttttgctgattctgacgagttcatcttccagtcgccgtctgggctgtttgagaagagaatcagtgttggcgagttgaagaagaggagagcgagataa

SEQ ID NO: 297 - DNA, 4035 bp, Kandleria vitulina DSM 20405
atgagtcaaaataataataaaatttataatattggattagatattggagatgcatctgtaggatgggctgtagtagatgagcattataatctattaaaaagacatgggaaacatatgtggggctcacgtttatttacacaggcgaatacagctgtagaaagaagatcaagtcgttctacaagaagacgttacaataagagaagagaacgtattagattgttaagagaaattatggaggatatggtattggatgtggatccaacattcttcattagacttgcaaatgtatcatttcttgatcaggaagataagaaagattatctaaaagaaaattatcattcaaattacaatttgtttatagataaagattttaatgataagacttactatgataaatatcctactatttatcatttaagaaaacacttatgtgaatcaaaagagaaagaagatccaagattaatttatcttgctttacatcatattgtgaaatatagaggaaatttcttatatgaaggccagaagttctctatggatgtttctaatattgaagataagatgattgatgttttgagacaatttaatgaaattaatctgtttgaatatgtagaagatagaaagaaaattgatgaagtacttaatgtattgaaggaaccactatcaaagaaacataaagctgagaaagcatttgcgttgtttgatactactaaagataataaagctgcttataaagaactttgtgctgctttggcaggaaataaatttaatgttacaaaaatgttaaaggaagcagagttacatgatgaggatgaaaaggatatttcatttaaattcagtgatgccacttttgatgatgcctttgtagaaaaacaaccattattaggtgattgtgtagaattcattgatttattacatgatatctatagttgggtagagttacaaaatatactaggttcagcacacacatctgaaccatctatttctgcagctatgatacagagatatgaggatcacaagaatgatttaaagttattaaaagatgttatccgtaagtatttacctaagaaatattttgaagtctttagagatgaaaagagtaagaagaataactattgtaactacattaatcatccatcaaagacaccggtagatgaattctacaagtatattaagaaactgattgagaagattgatgatcctgatgtaaagacaattcttaataagattgaattagaatctttcatgttaaaacaaaattcacgtacaaatggtgctgttccttatcagatgcagctggatgaattaaataaaatcttagagaatcaatcagtttattactctgatttaaaagataatgaagataagattagatctattcttacttttagaattccttattattttggtccacttaatataactaaagacagacaatttgattggattattaaaaaagaaggaaaagaaaatgaaagaattctcccttggaatgcgaatgaaatagtagatgtagataagactgctgatgaatttattaaaagaatgagaaacttctgtacatacttccctgatgaaccagttatggcaaagaattctttaacagttagtaagtatgaagttcttaatgaaattaataaactaagaattaatgatcatcttattaaacgtgatatgaaagataagatgctacatacattatttatggatcataaatctatttcagctaatgcaatgaagaaatggttagttaagaatcagtattttagtaatacggatgatattaaaattgaaggtttccaaaaagaaaatgcttgttctacatcattaactccatggatcgatttcactaagatttttggaaaaataaatgaatctaactatgatttcattgaaaagattatttatgatgtaactgtatttgaagataagaaaatcttgagaagaagattaaaaaaagaatatgacttagatgaagaaaagattaagaagattcttaaattaaaatatagtggatggtcaagattatctaagaaattgttatcaggaatcaagacaaaatataaagatagtacaagaacaccagaaacagttttagaagtaatggaacgcacaaatatgaatttgatgcaggttatcaatgatgagaaacttggcttcaagaagactattgatgatgcaaacagtacaagtgtatctggtaaattcagctatgctgaagttcaggagttagcaggttcacctgccattaagagaggtatttggcaagccttattgattgtagatgaaattaagaagattatgaaacatgagcctgctcatgtgtatattgaatttgcaagaaatgaagatgaaaaagaaagaaaagattcatttgttaatcagatgttgaagctttataaagattatgattttgaagatgaaacagagaaagaagcaaataaacatcttaaaggtgaagatgcaaaatctaagataagatcggaaagattaaagctttattatactcagatggggaaatgtatgtatacaggtaaatcattggatattgatagattagatacatatcaagtggatcatattgtacctcagtctttattaaaggatgatagtattgataataaggttttagtattatcaagtgaaaatcaaagaaaattagatgatttggttattccttcaagtataagaaataagatgtatggattctgggaaaaattatttaataataagattataagtcctaagaagttctattcattaattaagacagaatttaatgaaaaggatcaagaacgttttattaatagacagattgtagagacaagacagattactaaacatgttgctcagattattgataatcattatgagaatacaaaagttgttacagtaagagctgatttatctcatcaatttagagaacgttatcatatctataagaatagagatattaatgatttccatcatgcacatgatgcatatattgcgacaattctaggaacttatattggtcatagatttgaatcattggatgctaaatatatttatggtgagtataagagaatatttagaaatcagaagaataagggtaaagaaatgaagaaaaacaatgatggatttatccttaatagtatgagaaatatctatgcagataaggatacaggagaaatcgtttgggatcctaattatattgatagaattaagaagtgtttctattataaagattgttttgtgacaaagaagttagaagaaaataatggtacattctttaatgttacggttttacctaatgatactaattcagataaagacaatacattggctactgtacctgttaataagtatcgtagtaatgtgaataaatatggtggttttagtggtgtaaattcatttattgttgcaattaagggtaaaaagaagaagggtaagaaggtaatagaggttaataagcttactggtatacctctaatgtataagaatgcagatgaagaaataaagattaactatcttaagcaagcagaagacttagaagaagtacaaattggtaaagaaattctaaagaatcagcttattgagaaagatggtggattatattatattgttgcgcctactgaaattattaatgcaaaacaattaatattaaatgaatcacagactaaattagtttgtgagatatataaagcaatgaaatataagaattacgataatcttgatagtgagaagataattgatttgtatagattgctaattaacaagatggaactatattatccggaatatagaaaacaattagtaaagaaattcgaagatagatatgaacaattaaaagtgatttctattgaagaaaagtgtaatataattaaacaaattttagctactttgcattgtaattcttctattggaaaaataatgtattctgactttaaaattagtacgacgataggacgtttaaatggtagaacaatttcattagatgatatttccttcatcgcagagtctccgacaggaatgtattcaaagaaatataagttatga

SEQ ID NO: 298 - DNA, 4059 bp, Lactobacillus agilis DSM 20509
atgtctgaaaaagagtaccatttaggtcttgatattggaactaacagtataggttatgcagtgatggattgcaattatcatttaatgagagcaaagggtaaaacattaattggtacaagcttatttagagagggaaacacggcagcagagcggagaggatatcgaacgacacaaagacgtttaaaacgtcgtaagagaaggttaaaacttttagaagctttttttgatccttacatttttgaagtagacgagaacttcttagcgcgtctccatgaagctgatatttcgcctaaggatgaaaataaacgcttttggggctccttgctttttccaaatgaaaaggatgctaatttctataggaagtatccgacaatttatcatttgcgaaaggctttgatggaagaagataggaaattcgatgtaagggcaatatttttggcaattcatcatattatgaagtatcgtggtaatttccttagcccattatcggtagatagttttaagcaagaaggtttagaattaaaagaacaactagacaggcaattaaaacgagtggcagagttatacaacgaattaaatacggatgtcaaaattaatgtgagtgatgtcgaaactattcaagatattataattgataagaataaaagtaggcgtgacaaagctggagcacttaaaaagttactagcagtttcaagtgaccgtaaagaaattaataagctgaatgcttcacttgctaaggaattaagtaatgctatcttaggtatgaaagcccagtttgctaatttattgttagctgatgatttagaaatagacaaaaataagaaaaacttttcgctattggatactaatgccgaagaaaatgtcagtggattgttagaattagtcaatgaaaaacaagctgaattgtttgatgcaataaagacaattcatgatcaaattattctaaatgaaattgttccagacgggaagagtatttcgcaatcaatggtagataaatatgaggcgcatagggagcaattacaagtattaaaggctttgtacgaaaagatggatgctaagcaaatcaaagctataaagaaagcatatagtttgtatattgatgggaaggatccaaaagctaagaaagtagataagcgtgcacaccaaaatagggctgatttttataaagaggtaaagaaagtcttagttgagttagacgattcacgggctgaaaagttacttggtttaattgaaatgggacaattcttacctaaacaaagaacagcaatgaatggggttattcctaatcaattacaccaagtggaattagataagattattgaaatgcagtccaaatactacccttggttagctgagaagaatccagtgaaaagtcatcagaagcgggcgccgtataaattagatgaactgttaacctttagagtcccttactatgtaggtcctatggtgactagtaaaaaacagcaacaaacctctaatagtaattttgcttggatggttagaaaacaagaaggggagataactccttggaactttgaagaaaaggttgatacaattgcatctgcaaatgacttcatcaagcgaatgaccgccaaggatacttatctggttggcgaagatgttttaccagctaatagcctactatatcaacgttataaagttcttaacgagcttaacaatattaaggttaatggaagacgactaccagttgaattaaaacgagaagcatatgttgctttatttgaaaacggagatagtaaaacagtttcagctaaatgttttaaaaattggttgaacgttaaactgaaaaacttgaattcccttaaattagagggcctaagtactgggactaagtttgataataatttatccacttatcatgatttaaagaagatatttggtaaggcagtagatgatgctggcagacaaaaagattttgaacagattatagagtggcttacaatttttgaagataagaaaatcttaagaattaaactgaaagagattgagtggctgacggaagaaaatattacacaactaacccgacttaattataatggttggggaagactttcaagaagattattaactggaatttgtgatagtaatggtcaaagaattatggattggttgtgggacactactaataattttatgcaaattcagtctcaaccagattttcaaaaagccatcgtcgaatataatagtgataaattagagcaaggagatattgaacagattcttggtgaagcatatacatctccacaaaataaaaaagcaattcgtaaggttattaaggttgtccaagatgtagagaaggctatgggagctaaacctacatccatttccatcgaatttacaagaagcgatgggcgctcagaattgactaattcacgaatgacacaacttcaaaaaactttgatgagtctttctgaagaaatgacggaccaagctttgctagctgagtttaaagattttcaagcaagtaagaagaaactaacgaacaagtattatctatatttcactcaattaggtcgagatatgtacacgggggaaccgcttaatattgaccagttgagtttatatagtgatggcgatcatatcttaccacggtcttttattaaggatgattctttagacaaccgagtattgacaaaacgtgcggttaataatgagaaatcagatacggtacctgtttgtgaatatggtgctaaaatgaaggatttctggaatgatttatatgataacggactaattagtaaacaaaaactggctaacttgcttactgatccggacgagattggcccatataaggctaatggctttattcggagacaattagtggaaacttcgcaagttattaaattgtctgctgaaatactgcagacattgtatcaagatacaaaaatcatagaagttcgtcaaaagtatacacatgaactacgtgaacatttcaattttgtgaagattagacaactcaacgattatcaccacgcttttgatgcttatttaacggcgtttagtggacgatacttatatcaacgatatcctaagttacgtggttatttcgtttatggcgattacaataaatttgatgccaaaaaagaccgtaattacctaaaatcatacaatttcttgtatgatttagaagaaggaaagaccgaccaaatagttgataatgtcgaacataaggtattcatgaatcgtcaagacgcaattaatcaactgaaaaaagcatatgaatataaatatatgctagtatcgcaagaaacctatacaaacagtggagctatgtttaaggagactatctacccggtaaatccaaaacagaagttaattcaaaagaaaaacgataagccggttgacatttatgggggatattctaataactacgatgcttacctttccatagtacgattggaagataagaaaggtatcaaatttagggtggtaggaattccgatgagaaacaaggcggaattggataatcttgccaaagaggaccacaatggatatatgcaacgattaaatgagattgttgatgagcagataaatagttcaggtaagaaaaagacttttagaattatccttccaaaggttcattttaagcaacttgtagaagatgatagcggtaaatttatgttgggtagtgctgcgtacccatataatgcaaaacaattagttttaagtgtgaaaagtatcgaatctttagctaataaagatgctagtgatagggagttagtagctgtttatgaggaaatattgaacgtagtgaatgataaatttacgttgtatgatgcacgacagtttagaaataaattaacaagtagcaaagataaatttgtagaattaaatacagcagataaagtaacggaattgctagatattttggatgggttacatgctaatcctgttgttaaaaaattgaaaattatcagcgggagtccattcggatttttacaacgtccgtcaggaatagtgttaactgagaacgctaagttaatttatcaatcaccaactggtatttttgaaagagttgtttatttgagagatttatag

SEQ ID NO: 299 - DNA, 3957 bp, Lactobacillus animalis DSM 20602
atgggaagtaatatgctgaaaaaagattatagtattgggttggatattgggacaaactcagtgggacatgctgtagttactgatgattataaagttcctaccaaaaagatgaaagtttttggggatacatctaaaaaaacgatcaagaaaaacatgctgggagttttactgttcaatgaaggacagacggcagctgatacccgtttgaagcgcgggactcgccggcgctatacccggcgaaaaaatcgtttgcgctatttacaagagatctttgcaccagaattggctaaggtcgatcctaatttcttatatcgactagaagaaagttcactggtggctgaagataagaagtatgatgtgtatcctatctttggaaagcgtgaagaagaattactgtatcatgatacatataagacgatctatcacttacgcagtgcactagctaataatgatcaaccagctgatctaagattggtttatttggctttagcacatattatcaagtatcgggggaattttttactggaaggtgaaattgatctaagaactactgatatcaacaaagtatttgcggagttcagtgaaactctaaatgagaatagtgatgaaaatttgggtaaactagatgttgctgatatcttcaaaaataatacattctcaaaaacaaaaaaatctgaagaactgctgaaacttagtggggctaagaaaaatcaactagctcatcaattattcaagatgatggtcggcaatatgggtagcttcaagaaagtgctagggaccgatgaagaacacaaattatcctttggaaaggatacatacgaagatgatttgaatgacttattggctgaagctggtgatcaatatttagatatctttgttgctgctaagaaagtgtatgatgcagctattttggcaagtattttagatgtaaaagatacgcaaacaaagactgttttctcacaagcgatgatcgaacgctatgaagaacatcaaaaagacctaattgaattgaaacgagtctttaaaaaatatcttcctgagaaatgtcatgactttttcagtgaacctaagatcagtggttatgcgggatatattgatggcaaagtaagtgaagaagatttctataagtatactaagaagactttgaaggggatccctgagacagaagagatcttacaaaagatcgatgctaataattatttgcgaaaacaaagaacatttgataatggtgcgatcccgcatcaagtccatttaaaagaactagtggcaatagttgaaaatcaaggtaaatactatcctttcttacgtgaaaataaagataagtttgaaaagatcttaaacttccgaatcccgtattatgttgggcctttagcgcgcggaaacagtaaatttgcatggttgacccgagctggtgaaggaaaaataacaccatataactttgatgaaatgatcgacaaggagacttcagctgaagatttcattaaacacatgacgatcaacgatctatatctaccgactgagccagttttgcctaagcatagtttattatatgagagatacactatctttaatgagttagctggtgtcagatatgtgactgaaaatggtgaggctaagtattttgatgcccaaaccaagcgctcgatctttgaactttttaaattagaccgaaaagtaagtgaaaaaatggttattaagcatctgaaagttgttatgccagccatcaggatccaagctttgaaagggttggacaacggaaaattcaacgcttcttacggaacctataaagatttagttgatatgggtgttgcgccagaacttttaaatgatgaagtaaatagtgaaaagtgggaagatatcatcaagactctaactatctttgaaggacgcaaattgatcaaacgtcgcttagaaaactatcgtgactttttaggcgaagatatattacgtaaattgagtcggaaaaaatatacggggtgggggcgcctttcagctaagctgttggatggtatctatgacaaaaagacacataagacgatcttagattgtttgatgactgaagattacagtcaaaatttcatgcaattgatcaatgatgataactattcattcaaggaaacgatcaaaaatgcccaagtgatcgaaaaagaggaaactttggctaaaactgtacaggaattacctggaagtccagctattaagaaggggatcttacagagtttagagatcgttgatgagatcatcaaagtcatgggatataagcctaaaagtattgtagtcgaaatggcgcgtgaaacccagaaaacgcatgggacacggaaacgtgaagatcgagtgcaacagattgtggaaaacttaaaagatgctaatgaattacctgaaaaattgccaagtaatgctgaattgagtgatgaaagaaagtacttgtattgcttacaaaatggacgtgatatgtataccggggctcctctagactatgaccatttgcagttttatgatgttgaccatattattccgcagagctttttgaaagatgattcaatcgaaaataaggtcttaacgatcaaaaaagaaaatgtccgtaagactaatggtctgccaagtgaagccgtgatccaaaagatgggaagtttctggaaaaaattgttagatgctggagctatgaccaacaaaaaatatgacaatctacggcgtaatcttcatggcggattgaatgaaaaactaaaagaacgttttatcgaacgccaattggtcgaaacacggcagatcactaaatatgtggcacagctcttagaccaacgactaaattatgatggaaatggtgttgaacttgatgaaaaaattgcgatcgttactctaaaagctcagttagcttcgcaatttaggagcgaattcaaactgcgcaaagtaagagcgctcaataatttacatcatgctcacgatgcttatcttaatgctattgtagccaatttgatcatggcaaaatatcccgaattggagccagaatttgtctatggtaagtaccgcaaagctaagtttaaaggtttaggcaaagctacagctaaaaataccttatatgctaacgttttatatttcttaaaagagaatgaagtatatcctttctgggataaagcacgtgatctcccaacgatcaagcgttatttatatcgggcacaagttaataaagttcgcaaagctgaacgccaaatcggtggcttttctgatgaaatgttggtacctaagagtgattcaggtaagctactgccacgaaaagaagggctcgatccagttaaatatggtggctatgccaaagcggtagaaagttatgcggttttgatcactgcagatgaagtcaaaaaaggcaaaacaaagaaagtgaaaactttagtaaatattccgatcatagatagtaagaaatatgaggctgatccaactgcatatttagctagtcgtgggtatacaaacgtcacaaatagttttattttgcctaagtatagtctgcttgaagatccagaaggtcgtcgtcgttatctagcaagtttcaaggaatttcaaaaagcaaatgaattgatcttgccacagcatctagtagagttgctctattgggtcaatgcaaaagatggagagcaaaaattagaggatcataaagctgaatttaaagaattatttgataagatcatggagtttgcggataagtatgttgttgcacctaaaaattcagaaaagatcagacgcttatacgaagaaaatcaagatgctaccccaatggaattgggtaagaactttgttgagctcttgagatatacagctgatggtgctgcgagcgatttcaaattctttggcgaaaatattccacggaaacgatataattcggcaggaagtttgctcaatggaacattgatctatcagtcaaaaacggggttatatgaaacaaggatcgatctaggtaaattataa

SEQ ID NO: 300 - DNA, 3951 bp, Lactobacillus apodemi DSM 16634
atgcttcaaaaaaattatacgataggtttagatattgggactaattcggtaggttatgcggttatcaatgataattacaaagttccagctaagaaaatgaaagttttggggaacacagataaaaaaacgatcaagaaaaatttaatgggtgttttattgtttgatgcgggtgaaacagcagcaactactcgtttgaagcgtggaacgcgtcgacgttatactcgacgaagaaatcgattgcgctatcttcaagaaattttaggaccagaacttgccaaagttgatgccaactttttgcatcgtttggccgaaagttctctagttacagaagataaggaattttcagcttatcctatttttggtgatcgtgaagaagagttgctgtaccataagacatacaagactatctatcatttacgtagtgctttggctaataaggatgaaaaggcggatctacgcttgatttatttggcattagcacatattatcaagtatcgcggaaattttttgatcgaaggagagattgagctaagtgatactgatatcgataaagtttatgcagatttttgtagatctttcaatgaattattcgatacagaagtccttcaagagatagaagttgaagcgatcttcaaagataaaactctttcaaaaactaaaaaggcggaagaattagttaaagttagtggagtcaagaaaaatcaagtagctcatcaatttttaaaaatgatggtaggtaatactgttaattttaagaaagtgtttaatttaacagaagatcaaaaattatcgtttggaactgactcatacgaagatgaattaaatgatttacttgctaaaagtgatgatagatatttagatgtttttgtagctgctaaaaaagtttatgatactgctatcttagccaatatcttaaacacaaaaaattctgttgctactaaaacaatattttcacaatcgatgatcgaacgttttaaggatcatcaaaaagatttaaaagaactaaagcaattgttcaaaacgtatttacctgaaaagtacccggacttctttggaaactcaaaagaagatggttatgctgggtatattgaaggtaaaacaaatgaggaaaaattttatacacataccaaaaaaatactaaaaaatattcctcaggctgcatcggtcttagcccaaattgatgttggaaactacttaagaaagcaacgtacctttgataatggtgtgatcccacatcagattcagttaaaagagttgttggcgatcatcgaaaatcaaggtaagtactatccatttttactagaaaataaagagaagatcgctaagatcttaacttttagaattccatattatgtcggaccgttagcacgtggtaatagtagatttgcttggctaaaacgagtaggaaaagagaagatcactccatttaactttgaaaacgtcgttgatctagagagctctgccgagagatttattgagcgaatgacacttaatgatctatatttacctgaagaaaaggttttacctaaacatagtatgttatatgaaaagtttagtatttttaatgaattagcgggaattcgttatattactgacaatggtgaaatgaaatttttagatgcgcaaactaaacaaagtatttttgaactctttaaacaagagcggactgttaaggagaaaaaggttttagacctgttaaaaactttaatgccttcagagcgagttgttgcgataaaaggaattgataacggtaaattcaatgcttcttttggcacatatcatgatctgtcaaagatgggctttaagactgaaaaaatagccagtgagagtaaccaagctcgttgggaagaaatcataaaaactttaaccatttttgaggatcgaaagctgatcaagtcacgattaagaaaatacgacgattttttgaatgaaaaagagatcggagctttgagtaagcgtaaatatactggttggggacgcttatcagctaaattgatcgatgggatctatgataaaaaaacacatcagacgatcttagattttttgatgaacgaagactacaatcaaaactttatgcaattgatcagtaatgataattattcatttaaaaaaattattgaggattcacaagtgatcaaagaagaggggagtttgactgaagtaattcaagaactacctggtagtccagcgatcaaaaaagggatcttacaaagtatcgagatcgtagatgaattagttaaagtcatgggcggtaatcctaaaaagatcgtagttgaaatggcacgtgaaacacaaaagacccatgggacaacgcgaagagaagcacgaattaaggaaattatcaaaaatttaaataaattgaaattaaatgaattacctaaagatcttccaagtaatgaagagctaagtgatgagaaagtatatctttattgcctacaaaatgggcgtgatatgtatactggagcaccattagatcttgataatctcagtcagtatgaagttgatcatattattcctcaaagtttcttaaaagatgattcgatcgaaaataaggtcttaactgctaaaatcgaaaatagccgtaaaaccaatggacttccgagcgtagagatagctaagaaaatgggcgcgttttggcgtagtcttttaaaagttggggcgatctcagaaaagaaatatcgtaatctccgtcggagtctgcatggtggcatgacagaaaaattaaaagaaacatttgttaaacgccaattagtagaaacccgtcagatcacgaagtatgttgcgcaaattttaaatagtcgctttaatgaagaaaaaaatgaagataaagtagcgatcgtaactttaaaagcacaattaacttcacaattcagaaaagattttgaattatataaagtaagagagatcaataatttgcatcatgcacatgatgcttatcttaatgcagttcttgccactttacttatgactagtttccctgaattagaaccagaatttgtttacggtaaatatcgaaagacgaagttcaagggccttggtaaggctactgccaaaaataatttatacaccaatattttacagctattaaaagaagagtccgcacaatattgggatactaaagaacgtgatctagcaacgatcaagaaaaacgtatatcaagctcaggtcaataaggttcgaaaagttgagcgccaaacaggatccttttacgacgaaacggtagctaaaaaatctgcctcacaaaagttgtttccccgtaaaaatggtctagatccagtaaagtatggtggctaccagcgagcaaatgaaggatattccttactatttcgagctgatatgctcaataaacgtggaaaaacaaaaagtgtaaaaacattggtaaaaattccaattattgaaagtgcgcaatatttggccgatcctactgagtatttagctaaacgtggatattataatgtttctgaacatagtttgctattacctaagtttagtttattggaaaataataatgggctgagaagatatttagcttccagtaacgaatttcaaaaggcaaatgaacttattttaccaaagcatctagttagattattgtattggagtcagtctaagcagagaaaagaagaactaaacaagcatcgtgctgaatttgcagaattgttcacatatattatggattttgctgataaatatgttgttgcccctaaaaattctgaaaaaatcaagaatatttatgagaataataaagattcttcggtagaagtactagggaagaattttattgaattgctaaagtatacagctgatggtgctgcaagtgactttactttctttgatactaaaattccacgtaaacgttataattcagcgggtgatctattagatggaacattgatctatcaatctaaaacaggtttatatgagactcggatcgatttgggggcgatctga

SEQ ID NO: 301 - DNA, 4134 bp, Lactobacillus brevis subsp gravensis ATCC 27305
gtggaaagtaatcatgatggggaacaagttaagtacacattgggattagacattgggacatcatcaattggctatgccgcaattgataagcatcaaaaacccattcgggcaaaagggaaacatgtcattggcgttcgactctttcaagagggtcaaacggcggctgataggcgggcatttcggacaacacgtcgacgactgaaacgccgcaagtggcgattgaatttactgaatcgactatttgatccttacttatcagaagttgatccaaacttcctgccacgactgaggcaatccaacctttcacccaaagatgacaataagcattttaatggatcaacgttatttcccgataaaacagatgcggcgttttatcgacagtatccaaccatgtatcatttgcgatatgctttaatgaccgagaagcgcaagtttgatattcgagaagtctatctagctattcatcatattgtgaagtatcgaggaaattttctgaattcagcaactgttgattcatttaaaacatcaaatattgattttaccagtcaatttgatcgtctaaatgagctgtacaggcaagttattctggatgagccatttcaaattaatatggatcaagttgatgagatgaccaataagcttttggataacgacgctttgaaacttgatactcaaaagcaggtcgcaaagttattgcctgtgatttataatgacaagccaattgataagcaatataccaggattgcaactgaattttccaaagctattcttggatataagacaaaactggacgtcattttaaacttagatactcaaaatgctaaggattgggtaattcggttggatgatgaagacattgatgacaagttgcctgcactcgtggagaacttggacgaatcccgccaggaaatagtgacgattattcgcgacttgtatgctcaaattacgttgaacgcaattgttcccaaaggaaagtcgttgtccgaatcaatggtggataaatataatgaccataaagaccatttagatttactgatgggattgattcatgaattgggggatgattcagccaaagggattaagttgagggaagcttatacacaatacgttggcaagtctgatgataaaacactgaatcaggatgatttttacgcagcaattaaaaagaatttggacgaagattccaaacgttctccaaaaattcagcgtcttattgaacaggcaagttttatgcccaagcagcggacatcggccaatggcgttatccctcaccagttgcatcaattggaattggaccgaattattgaaaaccaggggcgctattatccattcttaaaaaaaccgaacccaaacactcataaaccaaatggtggcaagtacaaattagatgaattggttgcttttcggattccatactacgtgggaccgcttatcacaaagcgggaccaagaaaaaacttcaggtgcagactttgcctggatgatacgtaaacccggacaagagggagaaattacaccttggaattttgatcaaaaggtagatcgaatggcttccgcgaataggtttattcgcagaatgacaaccaaggacagctatctggtagctgaagatgttttaccagatgccagtctgatttacgaaaagttcaaagctttgaatgaattaaatatgcttaaagtaaacgatagtcgacttagtccaagtcagaagcaggatctttttaacaatctatttaaaaagcaaaagactattcgaacaaaaaaactgcagacatatatccgaacaaattgggagttaccctctgtgatgatttccggtctggctgatccggataaattcaattcaagcttatcaacgtatattgattttcgggatatttttggagaaaaggtcgatgatccaaatcgtcaggcagactatgaagaaattatcgaatggtcaacggtttttgaagatagaaaaatctaccaggcaaagctgaatcagttggattggctgacagagccacagagaaaagcattattaacaaagcgctacacgggttgggggcgactatccaagaaacttttgacaggcttaaaagatcagaatggcgattcgattctggaccagctttggaaaacaaacgataactttatgcaaattcaatccagagatgagtttgccaaacaaattcatgacgagaatgccaagcagttccacgaggcaaataatgttgatgatattttggatgatgcatttacttcaccccaaaataaaaaggctattcgtcaagtagataaagtggttcaagatgttgtcaaggcggttgggtatgcaccggataaaattgcgattgaatttacaaggtcacttgaaaataatccgcaacggacggtttcacgtcaacgtcagctacaagcagcgtataagaatatacctagagaaatcatgaaatcgggattaatggcagagcttggatcggttgctgacagtaaaaaagtgctttctgataagctttatttatattttactcaaatgggtaaagatatgtatgaagacaagacaattaatattgataatttacccaattatgatattgatcacattcttccacaggcatttattaaagatgattcgattgacaatagggtactcattagtaaagaagaaaatgcaaggaagtccaatcgagtaccgcttaaattctttggcgcaaaaagaatgggcttttggaaagatcttttgaataatggcttgattagtaaccgcaaatttcagaacttgactaccgatcctgagaagattagtaaatatagcgcaaaagggtttattcatcggcaattagttgaaaccagtcaggttattcgattagtggctaatatcttaggaaatgaatatagtcaagccggtacaactattattgaagtgagtgctaaaatgaatcgtcaattgcgcgaagactttcacttgattaagaatcggaatgtgaatgattatcatcatgcaatggatgcatatttgactgcgtatgttggggattatttatatctccgttatcccaagttaaggccatattttgtctatggtgattttaagaaagcagaggatcaagatctcaatattagaaatttcaatttcttacatgatttgaaagataatgaaagcttggataaaattgttgattcagaaaccggcgaaattgtttgggagaagcacgggtcagttaagcaattaaaaaaggtttatcattataaattcatgttggtttcccaagaagtttatacaaggcaggatgcattgtttaaccaaacgatttatccggcttcagatgccgataaacgaaagttaatcccgattaagaatagcaaaccggtcgatgtctatggcggttatagcggaaatatagatgcctatatggcaattgttcgtgttcatggtaaaaaagaagataattacaaagtggtcgggataccgatgcgagctgtaactaagcttaaaaaggctgagaaggaaggccatgatagttaccttaatgctgttcatgaggttctaaagccccagttcaccaagaaaaagaaaaatcgcaagaccggtgaaattactgagacagtggatgaatttgatgtactcctcggaaaagtttattatcgacaacttattgttgacggcaataagaaatttatgctgggaagttcatcttaccagtacaacgccaaacagcttgttttatcggataaagcgatgcaggttttgagtaagaatggtaaggtgaaaagccaggatgaaaatcaaaatctaattgatgtttatgacgagattttggaaaaggttgatcaatattttgaactgtatgatcaaaggcattatcgagaatcgcttcataaaggaagaggcatttttgtgaatctgccactcagcaaccaatatgatggcagtaagttaactagttatggtaagtatgaaacaattgacgcaattttgaatgggttacatgcgaatgcaacaatgtcaaatttaagatatctaggtatttcttcaccatttggaaaaatgcaagcttcaaatggattaaccattgatcctgattcgattatttgctatcagtcaccaacggggctatttgaaagacaaattaaacttagcgatctttaa

SEQ ID NO: 302 - DNA, 4116 bp, Lactobacillus buchneri CD034
atgaaagttaataattatcatataggtctcgatattgggacctcatcaattggttgggtcgcaattggcaaagacggaaaaccgctgcgtgttaaagggaagacagcgattggcgcccggttgtttcaggaaggcaaccccgctgccgaccgcaggatgtttcgaaccactcgacggcgtctgagtcgacggaagtggcgattgaagttattggaggaaatatttgacccatatattacacctgtcgattccacgtttttcgccaggttgaaacaatccaatttgtcaccaaaagattcacgcaaagaattcaagggttccatgcttttcccggatttgaccgacatgcagtaccacaaaaattatccaaccatttatcatttacgtcatgcattaatgacgcaagataaaaaatttgatattcggatggtttacttggccattcaccacattgtgaaatatcgcggcaatttcttaaactctacaccagtagattcctttaaggcatcgaaggttgattttgttgaccaatttaaaaagttaaacgagttatatgccgcaattaatcctgaagagtcatttaaaattaatcttgcaaatagcgaagatattggccaccagttcctcgatccatcaattcgtaaatttgacaagaaaaagcaaattccaaagattgttcctgtcatgatgaatgataaagtaacggacagacttaatggtaaaatcgcgtcagaaattattcatgctattttaggctataaagcaaaacttgatgttgtcctacagtgcaccccagttgattccaaaccatgggcacttaaattcgatgatgaggacattgatgccaaacttgaaaagattttacctgaaatggacgaaaatcaacaatcaattgttgctatcctacagaacttatattctcaagtaactttgaatcaaattgttcctaatggcatgtcattatcagaatcaatgatcgaaaagtacaatgatcatcatgaccacttgaagttgtataaaaagctaattgatcaactcgctgatccgaagaagaaagccgtcttaaagaaggcatatagtcaatacgtgggtgacgatggtaaagtcatcgaacaagccgagttctggtcaagcgtgaagaaaaatttggatgattccgagctctcaaagcaaattatggatctgatcgatgcagaaaaatttatgccaaagcaacgaacatcgcaaaatggggtgattcctcatcaactgcaccaaagagaacttgatgaaatcattgaacatcaaagcaaatattacccatggcttgtcgagatcaatcccaataagcacgatctccaccttgcaaaatacaagattgaacaattggttgcttttagggttccatattatgttgggccaatgataacgccaaaagaccaggctgaatcagcagagactgttttttcttggatggagcgtaagggtacagaaactgggcagattaccccttggaattttgatgaaaaggttgaccggaaggcatccgcaaacagattcatcaagcgaatgaccaccaaagatacttatttaattggtgaggatgttcttccagatgaaagcttattatatgagaagtttaaagtcctcaatgagttgaacatggtccgggttaacggcaaattattgaaggttgctgataaacaagcgatattccaagatcttttcgaaaactacaagcatgtctcggtcaagaagctgcaaaattacattaaagccaaaacaggattacccagtgatccggagatttcaggtttatcagaccctgagcatttcaacaattctttgggaacatacaatgatttcaagaaattatttggtagtaaggttgacgaaccagatcttcaagatgattttgagaagattgttgaatggtcaactgtatttgaggacaaaaaaatcctgcgggaaaagcttaacgaaattacctggttatctgatcagcaaaaagatgttttagaatccagtcgttaccaaggttggggccggctttccaagaaactgttaactggaattgtcaatgaccaaggcgaacgaatcattgacaaactttggaataccaataaaaatttcatgcaaattcagtctgatgatgattttgccaaacggattcacgaagcgaatgctgaccaaatgcaggcagtcgacgtggaagatgtgttggcagatgcgtacacttctccacaaaataagaaggccatccgccaagtggttaaagtcgttgatgatatccaaaaggccatgggcggagttgcgcctaagtatatttctattgagtttacccgttcagaggaccgtaatccacgtcggacaatttcacgacaacggcaacttgaaaataccttaaaagatactgctaaatctttggctaaatcaatcaatcccgagttactttctgaactggacaatgcagcaaagtctaagaagggcctgactgatcggttgtacttgtacttcacgcaacttgggaaggatatctacactggagagccaatcaacattgatgaacttaataaatatgacattgatcatattttgccacaggcatttattaaagataattcactggataaccgtgtactagttttaacggcggttaacaatggtaaatcggataacgttcctctaagaatgtttggtgccaagatggggcacttctggaaacagcttgctgaagcaggcttgattagtaagcgcaaactcaagaaccttcaaacagatcccgataccattagtaagtatgcgatgcatggattcattcgtcgacagttggttgaaaccagccaagttatcaaactggtcgcgaacattttgggagacaagtatcgcaatgatgataccaagattattgaaattactgcccggatgaaccatcagatgagagatgagtttgggtttatcaagaatcgtgagatcaatgactatcatcatgcgtttgacgcctacttaacagcctttttaggtagatatttgtaccatcgatacatcaagcttcgtccatacttcgtctatggtgatttcaagaagtttagagaagataaagtcactatgcgaaattttaattttctccatgatttaactgatgatactcaagaaaagatcgctgatgctgagactggtgaagtaatatgggaccgcgaaaattcaattcagcagttaaaggatgtttaccattataaattcatgctgatttcacacgaagtttatacgcttcgcggcgcaatgttcaatcaaactgtttatcctgcatcagatgccggcaaacgaaaattgattccggtaaaagctgatcgaccggtcaatgtctatggtggatatagcggcagtgcggatgcgtatatggcaattgtcagaattcataataagaagggcgataaatatagggttgtcggtgttccaatgcgggcactggatcgtttagacgccgcgaaaaacgtcagtgatgcggactttgaccgggctctcaaagatgtattggcaccacagctcacgaagactaagaagagtcggaaaacgggagaaatcacccaagtcattgaagattttgagattgttttaggaaaagtaatgtaccgacaattgatgattgatggtgataagaagttcatgcttggaagctcaacctatcaatataacgccaagcaattggtcctctccgatcaatctgtcaagacacttgcaagcaaaggaagattagatcctctgcaagaaagtatggattacaataacgtctacactgagattttagacaaggttaatcagtatttttctttatatgatatgaataaatttcgtcacaagttgaatcttggtttcagcaaatttatctcatttcctaaccataatgtccttgatgggaatactaaggtgtcttctggcaaacgggagatcttgcaagaaatattgaatgggctacatgcaaatccaacattcgggaatttgaaggatgtcggcatcacaacgccatttggtcaattacaacagcctaatggaattctgctgtcagatgaaacaaagattcgttatcagtcaccaacaggcttattcgaaagaaccgtcagtctgaaggacttataa

SEQ ID NO: 303 - DNA, 4149 bp, Lactobacillus buchneri DSM 20057
attgaggggattaaagtggaaagtaatcatgatggagaacaagttaagtacacattgggattagacattgggacatcatcaattggctatgccgcaattgataagcatcaaaaacccattcgggcaaaagggaagcatgtcattggcgttcgactctttcaagaggggaaaacggcggctgataggcgggcatttcggacaacacgtcgacgactgaaacgccgcaagtggcgattgaatttactgaatcgactatttgatccttacttatcagaagttgatccaaacttcctgccacgattgaagtaatccaacctttcacccaaagatgacaataagcattttgatggatcaacgctgtttcccgataaaacagatgcggcgttttatcgacagtatccaaccatgtatcatttgcgatatgccttaatgaccgagaagcgcaagtttgatattcgtgaagtctacctggctattcatcatattgtgaagtatcgagggaatttcctgaattcggcaactgttgattcatttaaaacatcaaacattgatttcaccagtcaatttgatcgtctaaatgagctttacaggcaagttattctggaagagccatttcaaattaatatgaatcaagttgataagatgaccaacaagcttttggataatgacgctttgaaactggatactcagaagcaggtcgcaaagttattgccggtgatttataatgacaaacctgttgataagcaatataccaggcttgcaactgaattctccaaagctattcttggatataagacaaaactggacgtcattttaaacctggatactcaaaatgcaaaggattgggcaattcggttagatgatgaagatattgatgataagttgcctgcgctcgtggagaacttggacgaatcccgccaggaaatagtgacgattattcgcgacttgtatgctcaaattacattgaacgcaattgttcctaaaggaaaatcgttgtctgaatcaatggtggataaatataatgaccacaaagaccatttggatttgctgatggggttgattcatgaattgggggatgattctgccaaagggattaagttgagggaagcttatacgcaatacgttggcaaatctggtgataaaacgctgaatcaggatgacttttatgctgcaattaaaaagaatttggacgaagattctaaacgttctccaaaaattcagcgtcttattgaacaggcaagttttatgcccaaacagcggacatcggccaatggcgttatccctcaccagttgcatcaattggaattggaccgaattattgaaaaccaggggcgctattatccattcttaaaagaaccgaactcaaacactcataaaccaaatggtggtaagtacaaattagatgaactggttgcctttcgaattccatactatgtgggaccacttatcacgaagcaggatcaagaaaaaacttcaggcgcagactttgcttggatgatacgtaaacccggacaagggggagaaattacgccgtggaactttgatcaagaggtggatcgaatggcttctgcgaatacgtttattcgcagaatgacaaccaaggacagctatctggtagctgaagatgttttaccggattccagtctgatttacgaaaagttcaaagttttgaatgagttaaatatgcttaaagtaaacgatagacgacttagtataagccagaagcaggatctttttaacaatctatttaaaaagcaaaagactattcgaacaaagaaactgcagacctatatccgaacaaagtgggagttgccgtctgtgatgatttccggtctatccgatccggataaattcaattcaagtttagcaacgtatattgattttcgtgatgtttttggagaaaaggtcgatgatccaaatcgtcaagcagactatgaaaagattatcgaatggtcaacggtttttgaagacagaaaaatctaccaggcaaagctgaatcagttggattggttgacggagtcgcagagtaaagcattattaacaaaacattacacgggttggggccgattatccaagaagcttttgacaggtttaaaagatcagaatggcgattcaattctggaccaactttggaaaacaaacgataactttatgcagattcaatccagagatgagtttgccaaacaaattcatgatgagaatgccaagcagttccacgaggcaaacaatgttgatgatattttggatgatgcatttacttcaccccaaaataaaaaggctattcgtcaagtagataaagtggttcaagatgttgtcaaggcggttgggtatgcaccggataaaattgcgattgaatttacgaggtcacctcaagatcggcctcaacgaacattttccaggcagcgacagctccagagtacctatttaaatgtcgccaaagcgttgatgaaatctaatttgaaccaagaactcaaatcagtgatcgatagccagcaaacactaacggataagctttatctgtacttcacgcagcttggtcaggatatgtatacaggcaaagaaattaactttgatgaacttgttaattatcaaatcgatcatattctgcctcaagcctttattaaagatgattcattagataatcgggtattggtcagtgcaccgattaataatgcaaagtctgacaatgttccggtaaagaaatttggtgccaagatgggttacttctggaagcagttggcagaaaatcatctcatcagcaagcgcaaactaaataatttgacaacagatccagataagattggtaagtttactgctcagggcttcattcatcgtcagttggttgaaacgagtcaggttattcgattggtagccaacattttgggaaatgaatatggccatgatggcacgacaattattgaagtgaccgcaaagatgaatcatcaaatgcgaaaggattttgacttaatcaagattcgggatgtaaacgattatcatcatgcaatggatgcgtacctgactgcgtatgtgggtgattacttatatctacgctatcccaaattacgttcttattttgtctacggtgattttaagaagcttaaagatcagagcttgaagattagaaactttaattttctgcatgatcttacaaacgatgaagctggtgataagattgtcgatcaagaaacaggcgagattatctgggataagcacgagtcagttaagcaattaaaaaaggtttatcattataaattcatgttggtttcccaagaagtttatacaagacaggatgcgctgttcaaccaaacgatttatccggcttcagatgccgataaacgaaagttaatcccgattaagaataacaagccggtcgatgtctatggcggctatagtggaaatgtagatgcctatatggcgattgttcgtattcatggtaaaaaagaagataagtacaaagtggtcggggtaccgatgcgagctgttgccgaccttaaaaaggctgaaagcaaaggtcgtgataattaccttaacgctgttcatgaggttttaaagcctcaattcactaagaaaaagaaagatcgtaagactggtgaaattactgagatgatggatgattttgacgtactcctcggaaaagtttattatcgacagcttattgttgacggcaataagaaatttatgcttggaagctcaacttatcagtacaacgccaaacagcttgttttatcggataaagcgatgcaggttttgagtaaggatgacaaactgaaaaatcaggatgaaaatcaaaatctaattgatgtttatgatgagatcttggagaaggttgatcaatattttgaattatatgatattaacaaatttcgtcagaaacttcatgacggacgaaagaagtttattgaattaccagtagacaacgattttaatgggaaaaagcttatttcatacgggaaaagagcaactatcatttcaattctaaatgggcttcatgcgaatgctaccatgtctaatttaaaatatttaggaatttcttctccttttggtatgcttcaagttccaaatggcataatcttaagcccagcatcaaggatttgttatcaatcgccaacaggattattcgaaagaaaagttaagcttagcgatctttag

SEQ ID NO: 304 - DNA, 3516 bp, Lactobacillus cacaonum DSM 21116
atggctaaatatagtgtggggttagatattggaatttcttcagttggttgggcaattattgatattgagacaaaacaaattgtgaatcttggaagtagaatttttccatctggaaatgcggcaggaaatcaagaaagacgcggttttcgtgggataagacgattgattagacgtcgcaagaatagattaacagatttaaagaaattattgggagaaacatttttctctgatttaaaaaaaattgattcaaatggttatgaatattatgatatcgatttccaaattaacgctaatccttatgaattacgagttaaaggaataacggagaaactatctaaaaaagagttagcagttgtattacatcatatcattaagcatcgtggtatttcttatgacttaggagatttggaagatgatgggacaagcggagttagcgattataaaaattcaatcaatattaatagacaattacttcgtgaaaaaacggttggtcaaattcagttagaaagactcattgagtttaaccaggtccatggacaagttaaaaaggctgaagatgtttcattgttgaatgtttttccatcttctgcatatcgtgatgaagcaaataaaatcatgattaagcaacaagaattttattctgaaattacgaattcattcatggaacaagtggatcaattagttagccgcaaaagagattattttattggaccaggtaatgagaaatcacgtactgattatggaatatataaaagtgatggacgaacattagataatttgtttgctgaactcattggaacggataagattaatggtgaaaaaagagcatcagcatcaagtttgactgcacaggtttacaatttattaaatgatttaaataatttgcatgtttctaatacagaagatggcaaattaacaacaagcacaaaaaaagaaataatcaaagcagctaaaactacagatggagtttttggaatatcccaaatttgtaaaattattggttgcaaaaaagaggaaattactggatttagacaagataagtctgaaaaaaaagttattcatacattagcaggatatcgaaaaattaggaaagctttggcaactataaatattgaggcgaatgagttaaatccaactgtttttgaccaaattgccgatattttaactcttaatacggaaaaagcagaaatccgaaaacagttagacaaagtccagttagatataactgatgagatgaaagaactagttattgataagaataaagattttttagtagatgggcgagctacatggcatagtttttcctatcaaacattaaacatgcttattcctgaattattgaatactagtgaagagcaaatgacaatattaactcggatggggttaatgaaatcagataatgagaaataccgcggattgaaaaagatacctgctgaaaaaattgcatcagaaatatttaatccggttgttgcaaagtcaacaagagaagcaatcaaagttttcaatgcaatatctaaagagataggaaaaaataatattgagcatgttgttattgaattgcctcgtgatgataatgaagaagatgaaaaaaggaaaattcaaaagctacaaaaagctaatgagactgaaaaagaggctgctgataatctagtaaagcataaactaggaatttcggattcagcattaattgcacattaccgtaagtttaaaggactttcgcaaaaggttaggtattggtatcaacaagaaacttattgtccatattgtgggaaaataatcgaagcaacacaactaattaataataacgataattttgaagttgatcatattattccaatttccgttagttatgatgattcacaaaataataaagtgctagttcatagccaatgtaatcaagctaaagaaaaacaaactcctttgggttggataaataatggtggtggttttggtcaaagcaagaatgaatatactaatagggttaaaaataataagaagtattcaaaaaacaaagttgataatttgttaaatgagacagatcttactgatattattacgcaacgtagttttattcagagaaatcttaatgatacgagatatgctgcacggacagtattagatgagttttattcattttttaaatcaaatgatttaccgacaaaggtcaaagttgtacgtggaaaatggacttctcaaatgcgaagaaaatggaataatgttgggggactaaggaaaactcgtgatacacatcatcaccatgcgattgatgccagcattattgcaagtttcccactattgagagctttcgatagagcgataaaattgattgatgtcgataaagaaactggagaaatagtacaatatgggaaggcctctttaaatggggacgtaatcgaggaaaaatcagtgattcaggcacctattataaaaaacgagaagttcgaaaaacttgttgatgaaatctataattttccgttatttaaacaagttgagctggcaaataatattgaaaatccagaaaatccggtgaaatttagtcatcatgtcgataaaaaagcaaatcggacagttgctaatcaaacaatttatagtacacgtattaaaaaaactgaaaaaatagttcgtaaaaaggtaacggctaaagaagaagagtatgttatcggaactattaaagatatttatgatgtaactaactttgaaaaattcaaaaaactttatgatgaatcttctaaaaaagatgatatcaaatttttaatgcagaaaaatgatccaaaaacatgggagaaattagttgaaatcatgaatacctacccagattatgaagaaattagtcagttagatgggaaagttaagcgggttaaagtttcgccatttaaactttattttcgtgaaaatggcttcattactaaatatgctaaacacaataatggcccgaaagtagtaagcataaagtattatgattcaaaacttggaaatcatattgatataacaccagttaatgctaataataaggtaatcttacagagcttgaaaccttggagaactgatgtttattataataatgaaacacaacaatatgaactgcttggtttaaaatattctgatttaaagttcacaaaaggtgtttatggaattactcgagaagcgtatgaaaagcttaagtatggctatacagacggtgtacctgcttggaaaccaatcagcaaagagagtgaattcaagtttagtttgtatagaaatgatcgtgtaagaattattaatgaagccggtgaaaaaatagatctcctatttggttctagaaatgaaacatcagaaggatacgttgaaatgaagccaatttttaagacgaattttgatgatgcagaggaagctagtttttatggaaagacatcaaataagagattaatcaagaaaatggctagaaaagggtaccaaatttataaggtgaatactgatatcttaggtaatctatactataccgcgaaagaatcgaatgaacctaaattagatttatag

SEQ ID NO: 305 - DNA, 4089 bp, Lactobacillus casei str Zhang
atgacaaagttaggtaaaccatatggcattggagtcgatatcggctcaaactcgattggatttgcggctgtggatgagaacagtcatcttattcgattgaagggaaaaacggttattggggcaagactgtttgaagaaggaaaagcagcagcgaaacgccgagcaggtcgtaccactcgccgtcgtttgagccgaaatcgttggcgactcagttttttgcgtgatttttttgaatcgcatattacgcctactgacccgaatttctttatgcggcaaaagtactcggaaatctcgccgaaggataaggcccgttacaagtatgagaagcggctttttaatgatcggacggatgctgagttttatcagcaatattcgacaatgtatcatttgcgcaatcggcttatgactgatccaagcagagcggatgttcgcgagatttattttgccattcatcatattttgaaaagtcgcgggcattttttgacgccgggagatgccaaggatttcaatacaaacgatgtggcgttagacgagatttttcctgcattgcaggatgcctacgcccaagtttacccagatcttggcattacttttgatgaggacaaagagaatgagtttaaaacaattttgctgaatgaaatagcaacgtcaattgatacgcaacgagctttagtcaaactgttactggctgaagaagacgacaaggacatcttgaagcagcagaagcaggttttaaccgagtttgctaaagctgtggtcgggttgaaaaccaaacttaatctagcgttaggaactgaagttgatagttctgaagccactgcttggaacttttcattagggcagcttgacgataaatgggctggcattgaatcggctatgaccgatgaaggaacggaaattctggaccagattcgggatctgtatcgagcccggctccttaatggtattgtgcccacaggaaagacgctttctcaagctaaggttgatgattatacacaacatcatgaagatctccagttgtttaaagcctatttaaaacaacttgaagatgatggaacggctaaagcaatccgacagctttacgatcgctatatagacggtgacgatgctgcgccatttttgcgagaaaattttgttaaagcgttaactaaagacgtgacggctcatccaaacaccaagtctcctgaactgcttgaacgtttggcgcaaccggacttcatgctcaagcagcgcaacaaagcgaacggggctattccagtccaaatgcaacagcgggaattggatcagatcatcaaaaatcaagctgtttattacgactggctggctgcgccaaatccggtggaaaagcatcggaaaagtatgccttatcagttggatgaattgctgaattttcgaattccatattatgttggaccattggtgacggctaaagagcaaaaagcagcacaaggcggggtttttgcttggatggttcggaaagatcctgaaggtaatatcacgccttataattttgacgaaaaggtagatcgcgaagcttcggctaatacctttattcagcggatgaagacgaccgacacttacttgattggtgaagacgtgttgcctaagcaaagtttgctgtatcaacgctatgaggtgttgaatgaactgaataatgttcgtgttaataacgagaagcttagcatcgaacaaaaacaacaagttattcgagaactgtttgaacggcataatagtgtgacaattaaacaatttgccgaaaatctgcgagcgcatggtgattacgcccacattcctgaaattcgtggtttagctgatgagaaacgttttttaagttcactttctacgtaccgtcaactgaaaagtcttttacccgaggcaattgatgatccagccaaacaagccgatattgaaaatatcattgcgtggtcgaccgtttttgaagacgcagcgatctttaaaacgaaattgaaagagatcagttggctcggcagcgaagccatcacgaaactaagcaacattcgatatcgggggtggggccagttttcgcgcaagtttttaaatggtctgacccttggcaacgggcatactatcattcaagaattgctcctgtccactaacaacttgatgcagatactaacagatgaaacgctacaaaagaaaatgaccgagctgaacgctgataaattgaaaacagcgaatatcaatgatgcgattgataatgcgtatacatcaccaagcaataaaaaggcattgcgtcaggttcttcgggttgttgatgatattaaacgcgctgcggatggtcaagatcctagttggttgtacgttgaaaccgcggatggcggtggtacaccaggcaagcgcactcgtgcgcgtcaacatcaacttcaggaaatatacgcgaatgcggcccacgagctgattgatacggcagtccgcggtgaattggaagataagatttcagataaggccgatttcaatgatcgactagtgctgtatttcatgcaaggtgggcgtgatatctacactggtgcgccactaaatattgatcaactaagtagttatgatatcgaccatattctgccacaatcgctaatcaaagataactctttagataatcgtgtattagtgcacgctattatcaaccgagagaaaaacgcaacatttgcatcaaccatctatgctcaaaagatgaacgcgacatggcgtcaatggcatgaggcagggctgattagcggtcgcaaactgcgtaatctgcaaatgcgtccagatcaaatcgataagtacgcgagcggctttgttgcccgacaattggtggaaactcgacaaatcatcaagctgacggaacaaattgtagcagcgcagtaccctgataccaaaattatcgccgttaaagcaggtctttcacatcaattgcgggaagaactcgaattccctaagaatcgtgatgttaatcactaccaccatgcttttgatgccttcctagccgctcggattggtacctatttactcaagcgattccctaatttacaggctttcttcacgtacggcaagtttacaaaagccgacgtcaaaaagcttcgcgggttcaactttatccgtgatatcacacatgctgaagataaaattgtggcaaaggataccggcgaggttgtatgggacaaacaacgggatgttgatgagctggatcgaatctataactttaagcggatgttaattacgcatgaagtccgctttgaaacggcggatttgtttaagcagacggtttatggggccagggattcgaaggaggctggcgggtcgaagcagctcattccaaagaaaaaaggatatccagttgatatttatgggggctatttcagagagaacacggcctatcttgccgttgtgaaagtgaccaaaaagacagagacaatctttaaagttgtcaaaattgcaacttcccaggttgcagctttgaataaagcaagatcacggtcaactgctgaggagctttcagtacttactgaactcctaaagccaaaatttagcaaggtcgggaaaaatggtaagatcactgatacaccattcgaggttgtgcttccgcgagttccgcgtgaacaacttttctataatgcaaagtatggtttctttatggttaactcagataccatgtttcacaatttccaagaaatttgggtgtctcgttcagaccaaaaaattcttcaacaaattagaaaagccaagattgactatcctaatgttgatcaagatttagacaatctttttcacaatttagccgatcaaattgtcaaatattttgatttgtattctattgcagggtttaaagagaaaatcagtcaaagtcaaaatactttcaatgatttggcggttgatgatactgaccagagtgtaggtaagataacggtcattaatgaattgttaaagggagcacaagctaatggcatgacgggaagcctaaaagttttaaagataagtaccccatttggatttacgcaagataaaagtggtgttcttacaaaagatagttccatcatctatcagtcaccaacagggctttttgaacggtctgttcgcctaactgacctgtaa

SEQ ID NO: 306 - DNA, 4188 bp, Lactobacillus ceti DSM 22408
atgagtaaaaaatatcaaaacacaaagtattatgtagggcttgatatcggaacgtcgtctgttgggtgggctgtaacagacgcgaattatgagttattaaaagttaatggtcataagacatggggatcaagattattcacagaggctgaaacggcacttgaacggcgaacacaccgcgctactcggagaagactgcaaagaagaaaacaaagactggatttattagatgaattatttgctgaagaacttgctaaagtagatccacagtttttacttcgtttgaaggaaagtcagtatcatatggaagataaaagtacagatgataagtatgttttgtttaatgatcaaaatagaacagatggagaattttttacagagtatccaacgatttatcatttgcgtagtgaattaatgcaagggaaaaaagaggatatacgtgcagtatatcttgcattacatcatatcgtgaaatatcgtggccacttcttattacctggagataattatgatatgcaaggtaatttaagtgaactgattaagaggctgtttaaatttattgaagaaactttatttattgaagatcttggattgacggatgaaattcaatccaaaatagaagaaattttattgacaaagacaaaaactcgtcttgatcgccaaaaagaaattgtcaaactttttaatacaaaacatcaaaaattagatgataaacaaaaaaaattattagaagctatttttaaattatgtttaggtcttaaaggtaatatggttaatatttttggtgacaaaggtgaatatggaattgattttactgatgtcgaagataagaagaaaaaggtagaatttagtgctgattatgataataacattaatgactatgtagatttctttggtgaatattttgaattgttagaaattacgaaaaaaattaatgatacagttattttttctgaaattttagtcgatggaaaaggtttttctgaatctaaagtaatttcttatgaaaaacatcaacaagatttgcgcaaattaaagacactcttgaagagtctagataaaaccttggggtataaatacggagaaggattataccaaaaaatattacttgatgatgtaaaatctaattatgttaattattcaggaaattctcaaaaattaaaaaaatgtactaaagatgagttttatgggtttatcaagagtaagttaaattcagttaccaagaaagaaaaggtttctgaagctcaacaaaaagaaatcgctcagattctcgctgatatggaatttggtgattatctaccgctgcaacgtacaactgataatggtgttattccaaaccaattacacaaaaaggaattaattgaaattattgaacaacaaactaagtatcatgattttttcaatgatgtagatgaaaatgggctaactattaaagataagattatttcattaatgacttttagaataccttattatgtcggaccattgaatgattatcataaagttgctgatggaacaggacatgcttggattgaaaagaaaaaagacggtaaaatctatccttggaattttgatgagatggttgatacagaggctactgcagaaaaattcattaaaaatttgacgaataaatgcacctatttaaaaggtgaagatgtattgccaaaagaatcgaagctgtattctgaatttatgttattaaatgaacttaataatattaaaatagataatcaaaaattggatcctaaattgaagatgaaaatggtatcagagttgtttatgaaaaaaaacgaaaagataacgaagaaaaaaattgttgattacttacgctcaattggtcaagctaatggtaacgagatggttagtggaattgatcgggaaatcaaatctgatctgaaaactattcataaaattcaacattattaccaagacgcatcgctagaaatggcggaaaatattattcgttggaataccatttttaatgattctacttctgacatattaaaggataaaatcacaaaagcatatggtgatgtattaactcctggtcagattaaaggattgtctaatctagcatgtaaagattgggggaaattatctgaaaaattcttaacaggtattcgttgtgatgtgggagaatttaaaaatattagtattattcaagctatgcgagatactaataataacttgatggaattattatcgaataaatatgaatttatggataagattcaagaatacaataaagaatattatggtgattttaccttcaaagcagaaccctctattatggatgatttatatgtgggacccggtccgaaaagagctatttggcaagcggtacggattgttgaagaaattaagcggattatggggcatgatccagaaaaaatctttcttgaaacaacaagaactaatcgggcaccaaaggttaagaacactaaacgttatgatgcgttagaaaaaaagtatgagtccgttaaagagcacgaatatgcagaagtaaagaaagaatttgaaattgaaaaaaatgatagtttaaatataaagaagttatttctttattttacacaactcggacactgcatgtattctgacgaaaaaattccttataatgaattattcactaatcgttatgatattgatcatatttatccacgaagtaaaacaagagataactctatggacaatctcgtattggtgaaagcagaatgtaatagagataagaaagataattatccaattaagcttaaaacaaatattcaacagaaatgtcaggttcgttgggcatatttacgtgataaaaaacttattactgaagaaaaatataatcgcttagtgcgtaaaacaccattaactgaagatgaattgtcacaatttattgccagacaattagtgtttacatcacaatctgtcaaagcaacagcggaagtatttaaaaggttatatgaagattctaaaatttgttatgttaaagctgagaatgttagtgactttagatatggttcaactagaaaaatgagtaaagatgatcaaccgcaaccttttatcaaaaatcgcgatgtgaatgattttcatcatgcgaaagatgcttatttaaatattgtagtgggtaatgtatatgatgttaaattcacacaaaatccaacgagatttattaaagcaaataaagattatagtttgaattatatttttagatatcctgtgaataaaaaaggtgagaatgtttgggatccagaacaatcgatgaagatagtggaaaaaacattgaaaagcaatgatgtgcgtgtcactaaattagtgaagccaatcactagtccaatatccaacgaaactcttcataaagcattaaaatgtaaacctggttcttatttaccacgtaaatcttctaaaggaacacccttggcagatgtgactaaatatggtggatatgaaaagattaaaaatgcatattacagtatttataaatatacctatatgaagaaaaaagaatgtatggaagagtttctacttgtacctataccaattcatttggtgaataacgatgaagaattaccaaaatatataaacgataagatagccgaaagagcaaaaaagaaaaaattggaaacagtcgagtgtattgtaaaagaattatatcaaggaactttagttagaataaatgggtatgattatcgtattgcaggaagttcgggaaaacaattcgaattgcataatgggattaatctgattgttgaaccttgggttgaaaaagttctgaaagaaacagataaattcgtgcgaaaatctaattcaaaattagataaaaaacaacaaaaagagaatacaactgaaactctgattgaaaaacaattaaatgatgtatttgaatatctctgtcggaaattaaatcaaggcatattcaaaaacaacaaacatacattacctgctaaactgttgggggatagtattcaaaaacgttttgaagatgctagtattgaagatgaatttgaggttataaaagaattgataagtgctatagcgaagaatcctcagaatttcaaaacgattcaaaaagtactagatatatccggcagttcgataccaagatttaatttaaagcttacaaaaaataatgtagacgagtttattattaaaaatgaatcggtgactggtttatttacacatgagaaagttatttttagaaaatag

SEQ ID NO: 307 - DNA, 3360 bp, Lactobacillus coryniformis torquens
atgggctatcgaataggcttagatgtggggattacgtcaactggttatgctgttttgaagactgataaaaatggactaccatataaaattttaacactagactcagtaatttatccgcgtgctgagaatccacaaacaggggcgtcattggcggaaccgcggcggataaaacgaggattgcggcgccgtacgcggcgaaccaaattccgtaagcaacgaacgcagcaattatttatacatagtggcttattgtctaaacctgagattgaacaaatcttagcaacaccacaagctaaatattcagtctatgaacttcgggtagcgggtctcgatcgtcgattaactaatagtgaattattccgcgttttgtacttttttatcggacaccgtggatttaaatccaatcgtaaagccgagttaaatccagaaaatgaagcagataagaaacaaatgggccaacttcttaattcgattgaagaaattagaaaagctattgctgaaaaaggctatcgaacagttggtgagttatatctaaaagatcctaaatataacgatcataaacgtaataaaggctacattgatggctatttaagtacgccaaatcggcaaatgttagttgatgaaattaagcagatcttagataagcagcgcgaattaggcaatgaaaaactaactgatgagttttacgcaacttatttactgggcgatgaaaatcgagctggtatttttcaagcacagagagactttgatgagggacctggtgctggaccttatgccggtgatcaaataaaaaaaatggtgggtaaggatatttttgaacctaccgaggatcgtgcggctaaggcaacctatacttttcaatattttaatttattgcagaaaatgactagtttgaactatcaaaatacaactggagatacttggcatacattaaatggacttgatcgacaggcgattattgatgctgtttttgcaaaagcagagaaaccgactaagacgtataaaccaaccgattttggcgagttacgtaaattattaaaattacccgatgatgcacgttttaatctagttaattacggtagtttgcaaacacagaaggaaattgaaacagtagagaagaaaaccagatttgttgattttaaagcctatcacgatttggtgaaagtattaccagaagaaatgtggcaaagtcgacagctattggatcatattggaacagcattaacgttatattcgagtgataaacggcgccgacgctattttgctgaagagttaaatttaccagctgaattaatcgaaaaactcttaccacttaatttttctaaatttggccatttatcgattaaatcgatgcaaaatattattccctatcttgaaatgggtcaagtttatagtgaggctactactaatacgggatatgatttccgtaaaaaacagatttcgaaagatacgattcgcgaagagattaccaatccggttgttcgtcgtgcggtaacgaaaacaattaaaattgttgagcagatcatccgtcgttatggtaaacctgatggcattaatattgaattagcgcgtgagttaggacggaactttaaggaacgaggcgatattcaaaaacggcaagataaaaatcgccagactaacgacaaaattgctgctgagctaacggaattaggtattccagtcaatggacaaaatatcatccgttataaattgcacaaagaacagaatggtgtcgatccttacacaggtgatcaaatcccatttgaacgtgcatttagtgagggttatgaagtcgatcatattattccgtacagtattagctgggatgatagctacaccaataaagtgttgaccagtgcaaaatgtaatcgtgaaaaaggcaaccgaattccgatggtctatttagcaaataatgagcagcgtttaaatgcgttaaccaatattgctgataacattattcgtaattctcgtaaacggcaaaaacttttgaaacaaaaactaagcgatgaagaattaaaggactggaagcagcggaatattaacgatacacgttttattactcgcgtactatataattatttccgccaagcaattgaatttaatccagagttggagaaaaagcaacgtgttttaccattaaatggtgaagtcacttcaaaaattcgcagtcgctggggatttcttaaggtgcgcgaagacggtgatttgcatcatgcaattgatgccactgttattgcagcgattacgccaaaatttattcagcaagtaactaaatatagtcaacatcaagaagttaaaaataatcaggctttgtggcatgatgctgaaatcaaagacgctgaatatgcagctgaagcgcaacggatggacgctgatttatttaataagattttcaatggttttccgttaccttggccagaatttctggatgaattgttagcccgtatttctgataatcctgtagaaatgatgaaaagcagaagctggaatacgtatacaccaattgaaattgctaagttaaagcctgtatttgttgttcgtttggctaaccataaaatctctggtccggcacatttagatacaattcgtagcgctaaattatttgatgaaaaaggtattgtgttgagtcgagtcagcatcactaaactaaagataaataaaaaagggcaagttgctaccggggatggtatttatgatcctgaaaatagtaataatggggataaagttgtttattcagcaatcagacaagcgttggaagcgcacaatgggtctggagaattagcttttccagatggttatttagaatatgtggatcatggcactaagaaactagtgcgtaaagttcgagtggctaagaaagtttcgctaccagtacgattgaagaacaaagctgcagcggataatggctcgatggtacggatcgatgtctttaatactggaaagaaatttgtatttgtaccgatttatattaaggatacagttgagcaggtactaccgaataaggcaatagcgcgtggaaaatcattatggtatcaaattactgaaagtgatcaattctgtttctctctatatccaggtgatatggtgcatatagaatccaaaacgggaatcaaaccgaaatactccaataaggaaaataatactagtgttgtaccaattaagaatttttatggttactttgatggagcagacattgcgacagccagtattctagttcgtgctcatgatagttcctataccgctaggagcattggtatcgctggattactaaaatttgaaaaataccaagtcgactatttcggtcgctatcataaagttcatgaaaagaagcgccaattgtttgttaagcgagatgagtaa

SEQ ID NO: 308 - DNA, 4107 bp, Lactobacillus curvatus CRL 705
atgagtcgtccgtataacattggtttagatattgggactagttcaattgggtggtcagtggttgatgaccaaagtaagctggtcagtgtaagaggtaaatatggttatggggttcgtttatacgatgaaggacaaacagctgcagaacggcgcagctttagaacaacacgtcgccgattaaaacgacgtaaatggcggttaggattgttaagagaaatctttgaaccctatatcacgccgattgatgatacttttttcttacggcaaaaacaatcaaacctaagtccgaaggatcagcgaaagttatatacacaaacaagtttatttaatgatcgaacagatcgggcattctatgacgattatccaacgatttaccatttaagatataggctaatgaccgagaaacgtcaatttgatattcgcgagatttatttagcgatgcatcatattgtgaagtatcgcgggcactttttaaatgaagcgcccgtctcatcctttaagagtagcgaaattaatttagtggctcattttgacagactaaacacgatttttgctgacttgttcagtgaatctggctttcaactagagacggataaattggcggaggtcaaagcgctcttattggataatcaacaaagtgctagcaatcggcaaagacaagcattatcactgatttatacgccaagtacgaataaggcagttgaaaagcagaataaggcgattgcgacagaattattaaaagcaatcttggggttaaaagcgaagtttaatgtgcttactgggatcgaagccgaagatgttaaagcatggacactcacttttaatgcagaaaactttgatgaagaaatggtcaagttagagagtagtcttgatgataatgcccatcaaattatcgaaagcctacaggaactttattctggtgttctattggcgggaatcgttcccgaaaatcaatcattgtcgcaagcgatgatcacgaagtatgacgatcatcaaaagcatttaaaaatgctaaaagcggtacgggaagcgttagcacctggagaccgacagagattaaagcaggcttatgaccaatatgttgatggtcaagaaaatacgaaggcctattcgaaggaagatttttacggagatatcacaaaagccttaaagaacaacccagatcatccgattgtgagtgaaattaaaaaattaattgaacttgatcaatttatgccaaaacaacggaccaaagataatggggcaatcccgcatcaactacatcaacaggaattagaccggattattgagaaccaacaacaatactatccctggttagcggaacttaatcccaattctaaacggcaaacagtcgctaaatataaattggacgaattagtggcctttagagtaccatactatgtggggcccctgattacggctgagcagcaacgacaaagctccgatgcgaaatttgcgtggctgattcgtaaagcagaaggccggattacaccgtggaacttcgatgataaagtggaccgtcaagcatccgctaatgaattcattaagcgcatgacaacgactgatacttatttattggctgaagatgtactccctaaacagagcttaatttatcaacggtttgaagtgttgaatgaattaaacggacttaagattgatgaccaaccgattacgacggagttgaaacaagcaatatttacggatttatttatgcaaaaaataagtgtaacagtgaaaaatattcaggattacttggtatcagaaaagcgctatgcaagtcgtcccgcaattactggtctatccgatgagaacaaatttaatagtcgattaagcacgtatcatgacttaaagatgattgttggagatgcggttgatgatgttgataaacaagccgatttggaaaaatgtattgaatggtcaacgatttttgaagacggcaaaatatatagcgccaaattgaatgaaatcgattggttaacggatcagcaacgtgtgcaattagctgctaaacgctaccgcggttggggtcgtttgtcggctaaattattaacgcaaatcgtcaatgcgaatggacaacgaattatggacttactctgggatacaacggataacttcatgcggattgtgcactctgaagactttgataaattaattactgaagctaatcaaatgatgctagctgaaaatgatgtacaagatgttatcaatgatttatatacgtcaccacagaataaaaaagcgctccgccagattctgcttgttgtcaatgacattcaaaaggccatgaaaggccaggcgccagaacggatattgattgaatttgcgcgcgaagatgaagtgaattcacgactttcggtgcaacgtaagcgccaagttgaacaagtctatcaaaatatcagcaatgaattgctaaataatactgaaatcagaaatgaacttaaggatttatcgaattctgcattgagcaatacgcgcttattcttgtacttcatgcagggtggtcgggatatgtatacgggtgattcgttgaatattgatcgtttatcgacgtacgatattgatcatattttgccacaatcgtttattaaggataactcactagataatcgggtattagtttctcaaaaaatgaatcgtagtaaagcagatcaagtaccgactgactttacaagtgtcgaacttggacaaaagatgcagattcaatgggaacagatgttgcgagctgggttaattaccaagaaaaaatatgataatttaacgttaaatccggatcatatcagtaaatacgccatgaagggctttattaatcggcaattagtagaaacacgtcaagtcattaagttagcaacgaatttattgatggaacagtatggtgaagataacattgagttaattactgttaagagtgggttaacccatcaaatgcgaacagaattcgattttccgaagaatcgtaatctaaataaccatcatcatgcattcgatgcttatctgaccgcattcgttggtctgtatctattgaagcgctatcctaaattaaaaccttattttgtatacggtgagtatcagaaggcaagtcagcaagataagtggcgtaactttaattttctaaatggtctaaagaaagacgaattggttgatgaaaatactgaagcggttatttgggataaagaatccggtctagcttacttgaataaaatatatcagtttaagaagattctagtgacccgcggagtgcatgaaaattcgggagcactatttaatcaaacgctctatgcggctaaagatgataaagcaagtggtcagggcgggaagcaattgattccagctaagcaagatcgatcaactgcgctctatggtgggtactcagggaagaccgttgcctacatgtgtattgtacgcattaaaaataaaaagggtgatctctataaagtctgtggtgttgagacgagttggttagcgcaacttaaacaactgacggatgaagattcacaaaaagcattcttagagcaaaaaattagtccgcaatttacaaaagtgaagaaacaaaaaggtaatatcattgaggccgtagaagaattcgaagtcattgcaccacatatcctaatcaatcaacgtttcttcgataatggtcaagaattgacattgggctctgcgacgtataaacacaatgagcaggaattgattcttgataaaacggctgttaaattattaaatggcgcgctacctttaacacagtctgaagaacttgctgaacaagtttatgatgaaatcttagatcaagtgatgcactatttcccactgtatgatactaatcaattcagagctaaattatctacgggtaaagcagcctttatgaagttaccatggaagagtcaatgggatggtaataagatggtgcaggttgggcaacaggttatattggatagaattctaattggattacatgcaaatgctgcgatgagtgatcttaaagtattgaaaatgaccacgccatttggaatgatacagcaatccacaggaattacactgtcggctgatacccaaattatctatcaatctccaaccggtttattcgaacgacgagtagctttaagggatttataa

SEQ ID NO: 309 - DNA, 4284 bp, Lactobacillus delbrueckii subsp lactis CRL 581
atggctaagcccaaagattatacaatcggccttgatattggtactaattccgttggctgggttgtaactgacgaccaaaacaatattctgcgaattaagggtaagaaagcaatcggtgcccgtttattcgctgaagggaaagtggcagcagaaagaagaagctttagaacgactagacgccgtctctcaagaagaagatggcggattaaactgctggaagagctctttgataaagaaattgccaaggtagacccgagtttctttgcaagactgcacgaatcttggatttcacctaaagacaagagaaagcgctactcagcaattgtctttcctagtccagaagaagataaaaagttccatgagtcatacccaacgatttatcatttgcgcgacaagctgatgaaggatgatcagaaacatgacattcgggaaatctacattgctgtgcaccaaatgattaaagcacgcggtaatttcttgcatgatgaatccgtagaaacttatcgttcagggatgagttcattgggtggccgaagcgaaagaaccattttaagcgttcaaactctggaagagttgaatgatctctttgctgaaaatgaaggcacggaggaagccaaattaaatgttgcttcagctgagcagattaatgacatcctcaccggtggccatttgaatgctgacagccaaaaagagattggtaaccttttgttgccaagcagcttcccaagtttcgatgacaaagcgaaggaaaagcaggtcaagaaactgatcaaaaatgtggcaacgaatatttctaaagcctggttgggctataaggcggatttctcaactattctgaatctcgccaatgttgacaaggatcaaaagaagatctttgcttttgctttacaaggcggggatgaagaagacaaagtacaagaattggaatccttgttggaacaaagccaaactgatattgtggatcgccttattgaaattcggcatgctattgttctgagtgagattgtcccagtcggaatgaccttgtctgaagcgatgatcgataagtatgatcagcataaagaagacttgattactttaaaggctgttattcggaataccaaggacaaaaagaaagctgccaaattacaagcaatttatgacttgtacgtcaacaaccgccatgcagatttggcaaaagcaatgaagttgactggaattaagaagagaagcgaactgcttgatcctgaggaactcaagaaagcaatttccagtttgttggatgactctccagaagctgttgaaattaagcaaatgctcgaggaaaagacctttttgcctttgcaaagatcaaacaacaatggtgtaattccaaaccagcttcatcaagtagagcttgatgagatcatcaagaagcagagtaagtactacccattcttggctgagaaaaatccagatgaatctgaagaagcccaaaagaaggctccaactaagttggatgcattgttgactttccgcgtgccgtactacgtggggccgatgattaccaaagaagaacaggaagcacaggacggccacagctttgcctggatggttcgtagagatcctcaagaccatgaggcgattactccatggaactttgagaaaaaagttgataagatggcttctgctactcagtttattaagcgtatgacaacaaaagatacttatttgcttggtgaagatgttttgcctgcatcaagcttgaagtaccagttgtttacggtcttgaatgagctgaacaatttacgggttaatggtaagaagctgactagtgatgaaaaagaacaagtgattgaaggcttgttcaagaagcagaagactgttaaagctgacaaatttgtcaaatattggcaagcaaagcatataggcgctgatattaaagttaaaggcctttcggatccgtcaaagttcaactcgacaatgtcaacctatatcgactttaagaaaatctttggtgatcagcttaatgatgtaaatcggcaaaatgattttgaaaagatcattgagtactcaacgatctttgaagaccgtaagattcttgaagacaagttacgggctgattttgcttggctgagcgaagaacaaattaagcaactttgccgtctgcgcttgcaaggctggggtcgtttgtctgacaaattgttgactcgtttgacagatgctgatgggcaaaatgttcttgaacgtctttggaatagcaatgacaactttgttcagattgtcagtgatccaaacatcaaggctaagattgaacaagaaaatcagaagctcctgcgtgatggccagtctgatgatgcagtagaaagtattttggatgatgcatatacttctcctcagaacaagaaggctatccgtcaagtaatgcgcgttgttcacgatattgtcaaggcatgtgacggcaatgtaccagcgaagtttgctattgaatttgctcgctcgcaagaggacgatccaaagagaactactgctagagtaaatcaaatgcagaagatctacgatcaaatcagtgatgaagtggtcagccagggcgtcaaagagcagcttagtggaatgaagtcactcaaagaccgctactacctatactttatgcagggcggcagggatgcttatactggtgcgaaactgaatattgaccggctgtcagattacgatattgaccacatcatgccgcagtctttcgttaaagatgattccttagacaaccgagttttggttgcgagagcagtaaacaatcaaaagtctgataaagttcctgctttgctctttggcaataaagtggttgctgatttaggaattactgttcgagaaatgtgggacaaatggcaaaagctcgggatgatttccaagagaaagttgagtaatcttctcactgatccggatgctctgacagaatatagagcacaaggctttattcggcgccaattggttgaaactagtcaagttattaagttgacggcgactattttgcaaagcgagttcccagacagcaagattattgaagttccagctaaatataactcgattgtgcgtaagcaatttgatttgtacaagagccgtgaagttaatgactatcaccatgctatagatgcctacttaagtacgattgttggtaactatctctaccaagtttatccaaacttgcgcaggatgtttgtctacggtgagtttaagaagtttagttctaatgctgaagaatcagcctatgatgtggttagacgcgttaagtcaatgaacttcttggatgatttgcttcgtggtacacatggtgacaatatttactgcagaagtactggtgaaattgtattcaacaggaacgatattatctctaagcttaagcaagcatactcttttaagcagatgctggtaacgcaggaggtctttactaagaaatcagccttatttgatcaaacggtttacccgtcaccagaaagagactcgaagaagcggtctggtttaattcctagaaagaagggaatggataccgagatctacggtgggtacagtggtaataaagatgcctactttgtcttggcagaggctgtaaaggaaaaaggacacacattgcagatcgtcggtgttccgattcgtgcgttaaacactctgaagaattctgcaaactattctgaaaagctgttagaaattattaagccgcaggtaatgtttaacaaggatactggtaaacctattaagggaatcaaggatgtcaaaattttaatggacaaaattccatgtcgtcagcctgttttggaaggtgaatcttattatatgcttgccagttcaaaatataggtatagtctcaaacaaatttccttaagtcaaatgtcaatgaagtacattcttgactatattgacgatccgaattttaataaacatgaaatgattaacattgatcaacaagacgaaaaggaatgtttgctctcagtttatgatgaaatcttagaaaagatggacaaatatcttccgctattcgatattagaagcttccgtaagaagttgcatgatggcagggatgcttttattgctttgccagtcgcaagcgaagaaaaaaagcctggtaaagttgatgttattagaaaggtcttgaaaggtcttcatgcaaacgcagatataacaaatttggctgaattgggctttggcacagcagcattaggtgctttagtgtcaacaggtggaattaagatttcagatgatgctgtattcatttatcaatcaccaactggattattcgaaagaagagtcaaggtctctgatttactgaaatag

SEQ ID NO: 310 - DNA, 4297 bp, Lactobacillus delbrueckii jakobsenii DSM 26046
gcgaaataaagagaaaaagaagggaaaaagaaaaatggctaagcccaaagattatacaatcggccttgatatcggtactaattccgttggctgggttgtaactgacgaccaaaacaatattctacgaattaagggtaagaaagcaatcggtgcccgtttattcgctgaagggaaagtggcagcagaaagaagaagctttagaacgaccagacgccgtctctcaagaagaagatggcggattaaactgctggaagagctctttgatgaagaaattgccaaggtagacccgagtttctttgcaagactgcacgaatcttggatttcacctaaagacaagagaaagcgctactcagcaattgtctttcctagtccagaagaagacaaaaagttccatgagtcatacccaacgatttatcatttgcgcgacaagctgatgaaggatgatcagaaacatgacattcgggaaatctacattgctgtgcaccaaatgattaaagcacgcggtaatttcttgcatgatgaatccgtagaaacttatcgttcagggatgagttcattgggtggccgaagcgaaagaaccattttaagcgttcaaattctggaagagttgaatgatctctttgctgaaaatgaaggcacggaggaagtcgaattaaatgttgcttcagctgagcagattaatgacatcctcaccggtgaccatttgaatgctgacagccaaaaagagattagtaaccttttgttgccaagcagcttcccaagtttcgatgacaaagcgaaggaaaagcaggtcaagaaactgatcaacaatgtggcaactaatatttctaaagcctggttgggctacaaggcggatttctcaactattctgaatcttgccaaggttgacaaggatcaaaagaagatctttgcttttgctttacaaggcggggatgaagaagacaaagtacaagaattggaatccttgttggaacaaagccaaactgatattgtggatcgccttattgaaattcggcatgctattgttctgagtgagattgtcccagtcggaatgaccttgtctgaagcgatgatcgataagtatgattagcataaagaagacttgattactttaaagtctgttattcggaataccaaggacaaaaagaaagctgccaaattacaagcaatttatgacttgtacgtcaacaaccgccatgcagatttggcaaaagcaatgaagttgactggaattaagaagagaagcaaactgcttgatcctgaggaactcaagaaagcaatttccagtttgttggatgactctccagaagctgttgaaattaagcaaaggctcgaggaaaagacctttttgcctttgcaaagatcaaacaacaatggtgtaattccaaaccagcttcatcaagtagagcttgatgagatcatcaagaagcagagtaagtactacccattcttggctgagaagaatccagatgaatctgaagaagcccaaaagaaggctccaactaagttggatgcattgttgactttccgcgtgccgtactacgtggggccgatgattaccaaagaagaacaggaagcacaggacggccacagctttgcctggatggttcgtagagatcctcaagaccatgaggcgattactccatggaactttgagaaaaaagttgataagatggcttctgctactcagtttattaagcgtatgacaacaaaagatacttatttgcttggtgaagatgttttgcctgcatcaagcttgaagtaccagttgtttacggtcttgaatgagctgaacaatttacgggttaatggtaagaagctgactagtgatgaaaaagaacaagtgattgaaggcttgttcaagaagcagaagactgttaaagctgacaaatttgtcaaatattggcaagcaaagcatataggcgctgatattaaagttaaaggcctttcggatccgtcaaagttcaactcgacaatgtcaacctacatcgactttaagaaaatctttggtgatcagcttaatgatgcaaatcggcaaaatgattttgaaaagatcattgagtactcaacgatctttgaagaccgtaagattcttgaagacaagttacgggctgattttgcttggctgagcgaagaacaaattaagcaactttgccgtctgcgcttgcaaggctggggtcgtttgtctgacaaattgttgactcgtttgacagatgctgatgggcaaaatgttcttgaacgtctttggaatagcaatgacaactttgctcagattgtcagtgatccaaacatcaaggctaagattgaacaagaaaatcagaagctcctgcgtgatggccagtctgatgatgcagttgaaagtattttggatgatgcatatacttctcctcagaacaagaaggctatccgtcaagtaatgcgcgttgttcacgatattgtcaaggcatgtgacggcaatgtaccagcgaagtttgctattgaatttgctcgctcgcaagaggacgatccaaagagaactactgctagagtaaatcaaatgcagaagatctacgatcaaatcagtgatgaagtggtcagccagggcgtcaaagagcagcttagtggaatgaagtcactcaaagaccgctactatctgtactttatgcagggcggcagggatgcttatactggtgcgaaactgaatattgaccggctgtcagattacgatattgaccacattatgccgcagtctttcgttaaagatgattccttagacaaccgagttttggttgcgagagcagtaaacgatcaaaagtctgataaagttcctgctttgctctttggcaataaagtggttgctgatttaggaattactgttcgagaaatgtgggacaaatggcaaaagctcgggatgatttccaagagaaagttgagcaatcttctcactgatccggatgctctgacagaatatagagcacaaggctttattcggcgccaattggttgaaactagtcaagttattaagttgacggcgactattttgcaaagcgagttcccagacagcaagattattgaagttccggctaaatataactcgattgtgcgtaagcaatttgatttgtataagagccgtgaagttaacgatttccaccacgctatcgatgcctacttaagtacgattgttggtaactatctctaccaagtttatccaaacttgcgccggatgtttgtctacggtgagtttaagaagtttagttctaatgctgaagaatcagctcatgatgtggctagacgcgttaagtcaatgaacttcttagatgatttgcttcgtggtacgcatggtgacaatatttattgcagaagtactggtgaaattgtattcaacaggaatgatattatctctaagcttaagcaagcatactcttttaagcagatgctggtaacgcaggaggtctttactaagaaatcagcgttgtttaatcagacagtatacccgtcaccaaagagagatggaagtaagagatctggtttgattcctcgcaagcggggaatggatccggaaatttatggcggatatgctcataatcaagattcttattttgtgttagctaaaattgaaaaagttaagggttataccttgcaaattgttggggtacctattcgatctttagaaataataaataaggcagaagatttctcaactgctttgttggacattataaagtcaaaggtgatgtacaacgaaaaaacaggtcaacctaagagaggaattaagaatgtagagattttagttaataagcttccctatcgtcaaccgattttagaaaaagatgtaagttatatgttaggtagttcagcctacaaatataacgtaaaacaaattacgcttagtcggcagtcgatgaaatacattcttgattacatcgatgatcctaattttacgaagcatgaaatgacaatgattgatgagcaaaatgaacgagaatgtttattatccgtttatgatgaaattttagaaaaagtagataagtatttgcctttgtttgacggtaataaattccgagaaaaactgcactcagctagaaaagaatttgtttcattatccgttgatgatgaagctagtgcaattgaaaagattctgcgcggattgcatgctaattctgagatgccaagtttggaaaacttaaaaattaaaccagcattgggctttttccaaatgaaaaatggtattacgctttcaaatgacgcagttcttttgtatcaatcaccaactggattattcgaaagaagagtcaaggtctctgatttactgaaatag

SEQ ID NO: 311 - DNA, 4092 bp, Lactobacillus diolivorans DSM 14421
atgagaggaaattatcacatcggtctcgatatcgggacatcttcaattggttgggcggtaatcgatgacaacgccaaggtcatgcgtgccaaggggaaaacagcgattggcgcgcgactgtataatgaaggtcaaactgccgcggatcgtcgactgtttcggacaacccgccgtcgactcaatcggcgaaagtggcgactaaagctgttggatgaaatttttgatccatacataacaccggtagatgcggccttttttgctcggttgaagcaatcaaacttatcacccaaggatcagaaccgcgactggacgggatcaatgttgttcccagatcgcactgatcgtaaatttcacaaggattatccgacaatttatcatttacgtcacaaattgatgactgaagatcaccaatttgatattcgtgagatttatttagcgattcatcacattgttaagtatcggggaaactttttaaacactacgcctgtgagttcatttagtgtctcagacgtaaaattcgatgaacaatttgaccggttgaacgaattatacgcggcggtttcacccgacgaaccgtttgcgattaatggcgataacagtaaagcaattgaaaccctgcttcttagtgacgagacaaaaaagttcgacaagcagaaacagtcagctaagttgatcttgtcagaaaccggcgataaagcgctcgataaagaaaatacaaaagtggcgactcagattagtaaggccattcttggctataaaacgcaactcgacgtcctgctcaaatacgatgcaattaattcttcggcttggaaaattgagctggacgatgaaaacattgacgatacgttgcctggcttgttatcccagttggatgagaatcgtcaggaaatggtttcaatcattcagaatctctatgcgcaagttactttaaatcagattgtgcccaatgggatgtcattgtctgaatcaatgattgaaaaatataacgctcaccgtgatcacttgaagctactcaaacagctcgaggataagattgacgatccgaaaaagaaaaagggcttggaagccgcctatgacgcttatgttggtaaaaacatgaaagtggccaatcaagatgtcttttacgccagtgttaaaaagaacttggatgattcagatcttgctaagcaaattgctgacctcattgaggcacaaaaatttatgccaaagcagcgaacttcgcaaaatggggttattccgcatcagcttcatcaacttgaactggatcaaattattgaaaaccagagtaagtattatccatggttgacggctgctaatccaaatccaaaacgaattcaccaagctaaatacaaacttgatgagttggttgcgttcagaattccatactacgtcggcccattggtaacccctgaagagcaggagaagtcggcaaatcaggtgtttgcctggatgaaacgcaagcagcccggcacgattacgccatggaactttgatcaaaaagttgatcgaatggcatcggctaaccgatttattcgccgaatgacgaccaaagatacttatttgattggtgaggacgtgttgccggacgccagtttaatttacgaacggtttaaggtcttgaatgagctaaacttggtaaaagctaattatcatcggctggcacctgctcaaaagcaggctgcttaccgcgatttgtttgagaatcaaaaatcaattagtacgaagaaacttcaaaattacttggttgaccaaggatattttacagccaaaccaaaaattaccggtttatctgatccagagcgatttaattcatcattgggaacctatattgatttcaaagaaattttcggtgatcaagtggataatccggaccgtcaagatgattatgagaagatcattgagtggtcaacggtatttgaagaccgccagatttatgaagccaagctgcgaacactggactggctcaccgaagatcaaattcaagcgttgaagacaaagcgatataacggctggggtcggctttccaagaaattgttaacggggattgttgacgaaaatggtgagcgaattattgacgttctctggaataccaaccagaacttcatgcaggttcaatcacaggaatcatttgctaaacggattcatgaagccaatgccaagcaaatgaaagtcaccggtgttgaggacattttggctgatgcctatacttcaccacaaaataaaaaagccatccgacaggttattcgggtggttgatgatattcaaaaggcaatgggtggtgtcgcgccaacgtcggtttcaattgagtttactcggtcggaagatcaaaatccgcgtcgaacgcaatcacgtgaaagtcaattgcaaaatacgtttaaggtggacgccaaagaaatcgttgatagtgatttggtaacagagttggagacggtttctaagagtaaaaaaggactaactgatcggctctatctgtacttcacccagcttggtaaagatatgtatacgggcgatccattgaatatcgatgaattgagcacttacgatatcgatcatattttgccacaagcctttattaaagatgattctttggacaaccgggttctcgtcagtaaagcggtcaataacggtaagtccaacaatgtaccagttaagctgtttggcggtaaaatgggtggcttctggaaagaattagcggatcatcgactgatcagcaaacgaaaattgaagcatctgctgacggatccagacacaattgataaatacaccatgcgtggcttcattcgtcggcaactggttgaaacaagtcaggttatcaaactggttgctcaaattttgggtgataagtaccaaaatgatgacaccaagatcattgaagtgaccgcaaaaatgaatcatcagatgcgggaaaactttaagctaatcaagaatcgtgaagtcaatgattatcatcatgctgtggatgcttatttgacagcctttgtgggccaatatttgtataaacgatatcctaagttgcggccatattttgtttatggcaatttcaaaaaattcaacgaagatcacgtgtcgttccgttactttaactttttgcatgagttaatggacgagaataataagcggattgtggagccggaaaccggcgaggttgtgttggaacgcgagccggcaattgcctatatgaagcgggtctatcactttaagtttatgctgatttcgcaggaggtgtatacgcgaagggatgctatgtttaatcagacgatttatccggcgaaggaagcgaatagaagaaaattaattgcgatcaagcatggcaaaccagttgatgtttatggtggatacagtggtagtgtggacgcttatatggcgatagttcgaattcatgataagaaaggagacaagtataaagttgttggggttccgatgagagcgttggaaattttaaatgcgactcatgataaaaaggactatgacgccaagttaaaacaaattcttgttccgaagtttaccaaggttaagaagagtcggaagaccggtgagattactaagaaggttgaagatttcgagattgttcttggcaaagtgatgtatcgacagctggtaattgacggtgataagaagtttatggtgggcagttcaacttatttgtataacgcaaggcaactcgtactttcagacagttctcttgacactttggcaagcaaagggactcttgattctgatgcagattctaaaaggctagttgctgtttatgatgaaatagtcgaaaaagttgataaatattttccactttatgataaaaatgcgttccgaagtggtctgcataaaggacgcgacaagtatttgctgttgccaaatcgaagtacctttaatggcgcaaaaaaggtccatagtggcaaaagagaaatactaaacgaaattttgaatggattacatgcaaatgcaacattgggaggtttgaaagatttgaaaatttcaactccgtttggaaaaatgcaaggtcaaagcggaattccattgtcatccaatactattatttgttatcaatcaccaactggtcttttcgaacatcgagtttcgttgaaagatttgtaa

SEQ ID NO: 312 - DNA, 4071 bp, Lactobacillus farciminis DSM 20184
atgactaaaaaagaacaaccttataatatcggtttagatattgggacaagctctgttggatgggctgttaccaatgacaattatgatctacttaatatcaaaaagaaaaatctctggggagtcagattatttgaagaagctcaaacagctaaggaaactcgactaaaccgttcaacaagacgacgctatagaagacgcaaaaatcgtatcaattggttgaatgaaatctttagtgaagaactagccaaaactgacccttcttttttaattcgactacaaaactcttgggtttctaaaaaagatcctgatagaaaaagagataaatacaatttattcattgacggtccgtacacggataaagaatactatcgagaatttccaacaattttccatttaagaaaagaattgattttaaataaagacaaagctgatattcgtttaatttatttagcacttcacaatattcttaagtatcgtggtaattttacttacgaacatcaaaaatttaacatatccaatttgaataataatttatcaaaagaactaattgaacttaaccaacaattaataaaatacgacatttctttcccagacgattgtgattggaatcacatcagcgatatcttaattggccgtggtaatgctactcaaaaatcaagtaatattttaaaagactttacattggataaagaaactaaaaagttgcttaaagaagtcattaatctaatcttaggaaacgtagcacatctaaatactatctttaaaacatcattaactaaggatgaagaaaaactcaatttttctggtaaagatatagaatcaaaattagatgatttagactccatactagatgatgatcagttcacagttctagatgcagccaacagaatatatagcactatcactttgaacgagattcttaacggcgaatcttattttagtatggctaaagtgaatcaatacgaaaatcacgctattgatttatgtaaactacgcgatatgtggcatactaccaagaatgaagaggctgttgaacaatcaagacaagcctatgatgactatataaacaaaccaaaatatggaactaaagaattatataccagtttaaaaaaatttttgaaagttgctctcccaactaatttggccaaagaagctgaagaaaagatatccaaaggaacatatctagtaaaaccacgtaatagtgaaaatggcgtcgttccttatcaattgaataaaattgaaatggaaaagatcattgataatcaaagccaatactatccatttctaaaagaaaataaggaaaaactactgtcaatactaagttttcgtataccttactatgtagggcctttacaatcagctgaaaaaaatccttttgcttggatggaacgtaagtctaatggtcatgcccgtccttggaactttgatgaaatagtagatagagaaaaatcttcaaataaatttattcgccgtatgaccgtaacagattcatatttagtaggtgaacctgtcttacctaaaaatagtttgatataccaacgatatgaagttcttaacgaattaaacaatattcgcataacagaaaatctaaaaacaaatcccatcggatctagattaactgtagaaaccaagcaacgtatttacaacgaactatttaaaaagtataaaaaagttaccgtaaaaaaattaacaaaatggttaattgctcaaggatattacaagaaccctattttaattggtttgtcacaaaaagatgaatttaattccactttaactacctatttagatatgaaaaaaatatttggctcgtcctttatggaagataacaagaattatgatcaaattgaagaactcattgaatggttaacaattttcgaagataaacaaatattaaatgaaaaattacattcttctaagtactcttacacacctgaccagatcaaaaaaatatctaacatgcgttataaaggatggggacgtttatctaagaaaatccttatggacatcacaactgaaactaacactccacaattattacaattatcaaattactctatattagatttaatgtgggcaacaaacaataatttcattagtatcatgtccaatgataaatatgactttaagaattatatagaaaatcacaatctaaataaaaacgaagatcaaaatatatctgatttagttaatgatattcacgtctcccctgctcttaagcgtggaatcacgcaatctattaagatagttcaagaaatagttaagtttatgggacatgcgcctaaacatatttttattgaagttactcgcgaaacaaaaaaatccgaaattactacttcacgagaaaaaaggattaaaagattacaaagcaaacttctcaataaagctaacgatttcaaaccacaattgcgcgaatatttagttccaaacaagaaaattcaagaagaacttaaaaaacataaaaacgatttgtctagtgaacggatcatgctttatttcctacaaaatggaaaatcactgtactcagaagaaagtctaaatataaacaaactatctgattaccaagttgaccatattttacctagaacttatatccctgatgattctttggaaaacaaagctttagtattggctaaagaaaatcaacgtaaagcagatgatttattattaaattccaatgtaatagatagaaacttagaacgttggacctatatgttaaataacaacatgatagggctaaagaaatttaaaaatttaactagacgtgtaattacagacaaagataaattaggttttattcatcgtcaattagtccaaacttctcaaatggtaaaaggtgtagccaatattttagataatatgtataaaaatcaaggaactacctgtattcaagctagggctaatctctcgaccgccttcagaaaagctctaagtggtcaagacgacacctatcattttaaacaccctgaattagtcaaaaaccgtaatgtcaacgactttcatcatgcccaagatgcttatttggctagtttcttaggtacatatcgcttacgtagattccctaccaatgaaatgttactaatgaatggcgaatataataaattctacggtcaagtaaaagaattatattctaaaaagaaaaagttacctgacagtagaaagaacggctttattatttctccattagtgaatggaacaactcaatatgatagaaatactggcgaaattatttggaatgtcggattccgagataagattttaaaaatattcaattaccaccaatgtaacgttaccagaaagactgaaattaaaactggtcaattttatgatcaaacaatctattctcctaaaaatcccaagtataagaaactcattgctcaaaagaaagatatggatccaaatatatatggtggctttagtggagacaacaaatcttccatcacaattgtcaaaattgataataataaaattaaacctgttgctattccaattcgattaattaacgatttgaaggataaaaaaacacttcaaaattggctggaggaaaacgtcaaacataagaaatctattcaaatcattaaaaataatgttcccataggacaaataatttatagcaaaaaagttggtctgttgtcattaaactcagatagggaagttgctaacaggcaacagttaattttgcctcccgaacactcagctttattacgactacttcaaatacctgatgaagatttggatcaaattctagcattctacgacaaaaatattctcgttgaaatactccaagaattaattacaaaaatgaaaaaattttatcctttctataaaggcgagcgagaattcctaatagccaacattgagaacttcaatcaggctactacctctgaaaaagtaaattcactagaagaattgatcactcttttacatgccaattctacttcagcacatttaatttttaacaatatagaaaaaaaggcttttggaagaaaaactcatggtttaacactcaataatacagattttatttatcaatctgtaactggcttatatgaaacaagaattcacatcgaataa

SEQ ID NO: 313 - DNA, 4062 bp, Lactobacillus fermentum DSM 20055
ctgatgcgtatcaaggggaagacggcaatcggggtgcggttgtttgaagaagggaagacggctgcagaacgccgaaccttccggacaacgcggcggcggttgaagcggcgaaaatggcgcttgcactacttagatgaaatttttgccccgcacttacaagaagtggatgaaaatttcttacgccgtctgaagcaatcaaatatccacccggaagatccagcgaagaatcaagccttcattggtaagctcttatttccggatctactgaagaagaatgaacgtggttacccaacactgattaagatgcgcgatgaattgccagttgagcaacgcgcccactacccagtaacgaacatctacaagttacgggaagccatgattaacgaagatcgccaatttgatctgcgggaagtttacctggccgttcaccacatcgtgaagtaccggggtcacttcttaaataacgctagcgttgataagttcaaagtggggagaatcgatttcgacaaatcctttaacgttttgaacgaagcctacgaggagcttcaaaacggcgaaggttcattcacgattgagcctagcaaggttgaaaaaattggacaactgttgctagatacgaagatgcgtaagttggaccgccaaaaagcggtcgccaaatttttagaggtgaaggtcgctgacaaagaggagaccaagcgcaacaagcaaattgcaacggccatcagtaagttagttctgggctacaaggctgattttgcaacggtagcgatggcgaatggcaacgaatggaagatcgatttaagttccgaaaccagtgaggacgagattgaaaaattccgggaagaattgagtgatgctcaaaatgatatcttaacggaaatcactagcctgttctcgcagatcatgctgaatgaaatcgtgccaaatgggatgtcgatttctgaatcgatgatggatcgttattggacgcacgaacgtcaattagcggaagttaaggaatacttggcgacccaaccagctagcgcacggaaagagtttgaccaagtgtataacaaatacattgggcaagcgccaaaggaaaagggctttgaccttgaaaaggggctcaagaagattttatccaagaaggaaaattggaaagaaatcgatgaattgctcaaggctggggatttcttaccaaaacaacggacatcagctaatgtggtcatcccgcaccagatgcaccaacaggaattagatcggatcattgaaaagcaagctaagtactacccgtggttagcaacggaaaacccagccactggtgaacgtgatcgtcaccaagcgaagtatgaacttgatcagctagtttccttccggattccttactatgttggaccgctagtaacgcctgaggttcaaaaggcgacatctggcgctaagtttgcttgggcaaagcggaaagaagatggggagattaccccttggaacctgtgggataagattgaccgtgctgaatcagctgaagcctttatcaagaggatgacggttaaggatacgtatctattaaacgaggatgtcctgcctgctaacagcttgctataccaaaagtacaacgtcttgaacgaactaaacaacgtgcgggtgaatggacgccgcctgtcagtcggaattaaacaagatatttactctgagctcttcaagaagaaaaagacggtgaaagcaagtgacgtggccagcctagtgatggcgaagacacgaggagttaacaagccaagtgttgaaggtttatctgatccgaagaagttcaattcaaatttggcaacctaccttgatctaaagtcaatcgtaggtgacaaagttgatgataactgttatcaaacggatctcgaaaatattatcgagtggcgttccgtctttgaagatggggaaatttttgcggataagttaactgaagtggaatggctgacggatgagcaacgttctgcccttgttaagaaacggtataagggctggggacgtttatccaagaagctactgacgggaatcgttgacgagaacggccaacggatcattgatctgatgtggaatactgatcaaaacttcatgcagattgtcaaccagcccgtctttaaagaacagatcgaccaactgaaccaaaatgccatcaccaatgatgggatgaccttgcgggagcgggtcgagagcgttctggatgacgcctatacttcaccgcagaacaagaaggccatctggcaagttgttcgggtggtggaagatattgttaaagctgtcggaaatgcaccaaagtcgatttcgattgaatttgcccgtaatgaaggcaacaagggagaaataacccggagccggcgtactcaattgcagaaattatttgaagatcaggcccatgaattagttaaggatacgagcttgactgaggaattggagaaggcactggatctttccgatcgttattacctctacttcacccaaggtggtaaggatatgtacaccggtgatccaatcaacttcgatgaaatttctaccaagtatgatattgaccacattttgccacaatccttcgtgaaggatgattccttagataatcgggtgttagtaagtcgggcggagaataataagaagtctgaccgggtgccagctaagctttacgcagccaagatgaaaccatactggaaccaacttttgaagcagggattgatcacgcaacggaagtttgaaaacctgacgatggacgttgatcaaaatattaagtatcggtcacttggattcgtgaagcgccaattagttgaaacacgccaagttatcaagttgacggctaacatcttgggtagtatgtaccaagaagccgggacggacatcattgagactcgggctggtttaactaagcaattacgcgaggaattcgatttaccaaaggtccgtgaagtaaacgactatcaccacgcagttgatgcttacctgacgacgtttgctgggcaatatttgaaccgccgttatccgaaattacgctccttcttcgtatacggtgagtacatgaagttcaagcgcgggtcagatctgaagctacgtaactttaacttcttccatgaattgatggaaggcgacaagagccaaggtaaggttgtcgatcaacaaactggtgagctgattacgacaagggatgaagtagccaagagctttgatcgattattgaacatgaagtatatgctggtatcgaaggaagttcacgaccggagtgaccaactgtatggagcaacgattgtaacagcaaaggaatctggtaagctcacttcaccaattgagatcaagaaaaatcgacctgttgatttgtatggtgcttatacgaatggaacgtcagctttcatgacgatcattaagtttactggaaacaaacctaagtataaggtgattggggttccaacaacatcggcggtcggtttaaaacgagttgggaaaccaggcagtgaatcatataaccaagaattacatcgaatcattaaatctaatccgaaggtaaagaaagactttgagattgtagttccacatgtttcgtatagtcagttgatagttgatggtgactgcaaatttaccctagctagtgatacttatcagcatccggcaactcagctagttctttctaaagaatcgatggaaataattgcagatgattttaaatttgtgaaagaaaatccggcaactgcggatgaacaacttgttagggtttttgatgaaattgttaatcaaatgaaccattactttactatctttgaccaacgtagtaatcgtcaaaaggtaacgaaggctcgagataagtttgtatcgttaccaacggaatcagagtatgagggtgctaagaaaacgcaagtagggaagacagaagtcattacgaacttactgatgggtctacatgccaatgctgcacaaggtgatttgaaagtattaggattatcaacctttgggtttttccagagttcaggtggactgaatttaagtgaagatgcaatgatcgtataccagtcaccaaccggtttgtttgaacgtcgcatttgtttgaaagacatttaa

SEQ ID NO: 314 - DNA, 4041 bp, Lactobacillus floricola DSM 23037A
atgaatcaaacaaaaaactatgacatcggattagatataggggttggatctgttggttggacaatcaccgattctcaatctcaaaaggttcttaaagtaaaaggtaagcaaggtattggtgtccatctcttcaacgaaggtcaaactgctgaagaacgtcgccagtttcggactaatcgtcgtcgtttaaaacgtaggaagtggcgtctaagattactcagagaattatttgatgaaccaatttcaagcattgatcctgaatttttcgcccgcttgaaatacttcaatgaatctagtaaagacccgaaaaataaaggctatcaacctcaattacacgatgatctaaaagatgttgacttctatcgtcaatatcctactatctatcatcttagacatgccctcatgacacaaaaagaaaaattcgatattcgtgatatttacttagcaatacatcatatcgttaagtataggggtcactttctcatgaatggtcacagtagtagcttttcagttgcccaaacagattggaaagcagatttaactaagctatttgaattaattcaagaaacacgcaccaacctcgacttctctttcgatttaacagaaatcgatactatcaagtctttattatttgataaaaatttaagtcgaaatgacagacaaaaagaaattgttggcttaatcaataataactcgcaattagataaaaaagataaagccctaaccaaacaactcgttgaatctgttgttaagggcattgttggtatgaaaaccagaactgatattttgcttggatatgaagttgataacaaagaacaaagtaaagcttggaacttttctattgatgagcttgatgatcaaatggctacaattgatcctgccttaagtcaaaatagtcaagctcacgatattattacgctgattcaaaagctctacatgactgttcaattagcacaaattgtgccagaaggacagtctgtatctgaaatgatgattaatcgttacaatctctatgctgaacagcttcaacaacttaaagactacaaaaaaatcaatcttgaaacgggtctattactacgtgaagcttatgatgagttaatgaccaaagcattaaccgctgcacctggcaaaactattcatgatactttctacaacaaagtcaaaaaaatactgaaagaccaagataataaacaagcgctgtcaatcaaacaagccattgaagacagtaattatctcattcctctcagaattaaaagtaatggcgtcattccttatcaacttcatcaacgagaattagacgctattattgaaaaccaaaaagaattctatccattcttagccacacctaatccagttgacggacatcaagaagctttgccctataaattggatgaattaattggctttaaagtaccgtactacgttggtcctatggttgatccggaagttgattctgaccaaaattttgcttggatggttagaaaagaaaaaggcgagattacaccttggaacttccataataaagttgatattacacaatcagcggataacttcattaaacgtatgaaaacaaccgatacttacttaattggtaaagatgttttacctcaaaatagcctattatatcaacgttataccgtacttaatgaactaaacgggattaaagtagccaacaaaaaattaactattgaacaaaaacaacgtctttatgatcagttgttcaaaaagaaaaaaacagtcaaaaagcaagacatcctcaacaatctagttgctgcaggtgaaattcatgaagatgataatctgactggattatcaaacggtacaacctttaataacaatttaggcagttacatagattactgcaaaattattggccaggataaattagaagatgcttccaaacaagccgatattgaaagaataattgaatggtccacaacatttgaagatgctaacatcttcttaacaaaattagcagaaatcaactggctaacagaagatcaacgccaaaagctgagtcaaattcgctaccgtggatgggggcaattctcaaaaacattgttaaccgatatcaaagacaataaggataactcgattattgataacttgatgtctaccaaaaaggtattcatgcagattatcaacgacaccacaatcaaacaaaaaattgacgattacaatcaatatcatcttaatcatgcagacttaaaagacaccattgctaacctcttcacctcgccacaaaacaaacgtgccattaatcaaacgttgctagtcattgaagatattattaatgctgttggtcacaagcctaatcgtatttttattgaaagtgctaaagataaccgtaatgctaaaaatcagttaactcaaagtcgattaaaacgtattgtgaaacaattcgaagacaataaacaacatgttgatcaatccgtttatgaagaacttaaacaactagatgatggttctcatgcttcaattgatgaccgcctactcttatacttcctacaaaatgggaaagatatgtatactggtcaacctattgatatttcacaactaagtactagccaatatcatatcgatcacatcctgccacaagccaaagtaatggataatgctttagataatcgtgtgctggttagttcaaaagccaatacagaaaaatcagaccgattcttgagtgaaatcccccaatttcaacaacgttcattatgggcagaacttgaacgtatgggattcttgactaaagctaaaaaagaaagactgctaatgacatcagatgaattcaaacaaaactcagttaggttcatcgctcgtcaattagttgagactcgccaaatcatcaaattagttaaccagttaattattcaagagcatcctgaagtgaaactagttaatattaaggccgacttgactaatgccttcaggaaaaagttcaatttcgtcaaaaatagaaatgccaatgattatcatcatgcattcgatgcctaccttaccagcttgattggtagtcatctgctcaagtctcaccctaaatgggaaccactttttgtttactcagactatgacaaaattaaattcgataatgccccacaaggtgtgaatatcatgaaagaattcgagcagtctaaattagctgatgaaaatggcgaaatcatctggaataaagatgaaatgatggcttacctagaacgcttatataattcaagacaaattcttatcaccaaaaaagtttatgcacgtcatggtaacttgttcaaacaaaccatcttcaaagctggtgaaagtgataacttaatccctgtcaaaaataatcgttctgatattgctatctatggcggatacaaaagtaaacaagtcagttactatgccctaattagtctgcataacaaaaaacgtcaaaagagattagtagcggtctatcttattgatatccaaaaactccaaaatctcaatgaaagtgactactttaagaccttacacaccattatcaaagaacgtcataacatcaaacctgagttcgatattctagctgataaaatctatcaaaatcagctaattattgacaataaaaatggttcaaaccgaccattcagaattgagggtgacttcaaaaatgaccgtcaactctacttgcctttacaataccaacgttggctggcatctaaagaacctacagatgaaaaactcaaccgtatatttgatcacatttgtgaacaattagctgactacttcccactatttgcgggcaatgcctgtgacaaattgctggataatcgtgataagttctatcaattatcaatcaaaagtgaattcaacgataaaggcaaactaatagctgaaggtaaactatccgtaattgataaactcttagtagcaatgcatgctgatagtcgtaattctaatttagctgtaataggactatcgtcatcttggggtagatttaaattgcacggcggaaacgaagcaatcggcacatcagttcaactaattcatcaatcaccaacaggattattcaaacgcatccaaaggtttaactaa

SEQ ID NO: 315 - DNA, 4209 bp, Lactobacillus floricola DSM 23037B
atgacatatagaaactatcatattggactagatattggaacatcgtcagttggatttgctgtaagatatgacaatggtgaattagttcataaaaaaggaagcaacttagttggggctagattattcaaagaaggggaaacagccgaagaaagacgtcttaataggggagcacgtagaagatataacagaagaaaatggcgtttaaatttattaaatcaaattttcaaaccattaattgaagtaaatgatccaacattctttaaaaggctagaacagtcaaacctagttaattatgataaatcagaatcttttagcttattaaataatcaatcagatgataagttgcatcagcaattcccaacaatttatcatttaagagattatttgatgaaaagcacagaaaaagcagatattaggcttatttatttagcagttcatcatattgttaagtatcgaggcaattttttagatgcttcgcctgtagattcatttgaagcatctaacttaaaggtagacgaaattcttacacaaattaatttattattggataatttaacagacgatttacgacttaatactcaatatgtaacagacatcgaacaaactttactttccaatactgaaagtaataaagataaagaaaaagttattcaaaaactactactacataaagaagcaattaagattgataaagataggactgctcagattgcgaaattggttttaggttataaagctgacatagccaaattatttggaattactgaaaaacttcaaacacctaaattagaattatcagctgccaatagtgacgatgctttgatggaactaagtgcagaattaaatgaagaccaaataggtattttactccaattaaaaacactttattcaagagtcagacttaaccaaattattccttcaggaactagtttatctaagtctatgattgaaaaatatgagttgcatcatacacaattaaaatcattcaaagaaaacattttattaaagttacgaagaaatactgcagttagacgaaatttagaattagcttatgctttatatgttgggaacgctcagacaaaacaagaagtttttgaacctaaaaaagctcgatttacaagtgatgactttgcgagtttaaaagctaatgcaaaatcagcatctagtgttaaagaggcacccaaaaatacaaaaacgaaattaacaactgatgacttctacaatatactaactgaactgtttgcgacatttgaatcagaattgtcagcagacgaagatatgataaaagaagttgaacaaattaaaaaagcaattactggggataattatttacctaagcaaagaacagatcaaaatggtaatattccgcatcaactgcatcaaattgaattaaggcaaattcttcaaaatcaactgccacattatccagaaatggataaaatcaatgagcaaaagccaatagaaaaactagtaacatttcgtgttccttattatattggcccattaattacgcctgaagaccaacaaaagtcatcagctgctaattttgcttggatgaagcgaaaagaacaaggtgcaattacaccttggaattttgatgataaagttgatcgcatgcaatctgctacaaactttattaaaagaatgactgttaaagatacttatttaattaatgaagatgttttaccagatagaagtctcttataccaaagatttaaagttttaaatgaattaaatttagtcaaagttaataaccaattgttgtcaattggtgagaaacaagctatttatcatgatttattcgaaaaacaaaaaacagtaagcactaaaaaattgcaaagttatcttcaaagcgaacaaggatatggggataatatcgagatatcaggcttatcaaatccagacaaatttaataatggcttaactacatatattgatttcaaaaatatttttggtgatttagtcgaagatacaacgaagcaaaaagaatttgagcaaataatagaatggtcaacagtatttgaagatagagctatttttaaagcaaaattgcaagaagtgaactggttgacagaagaacagattaaggcactggtagctaagagatatagtggctggggcagattatcttatcgactactcgcagagttagtaaatgacaatggtgaaagaattattgatattttgtggaataacaaagggagcaatttgatgagtattgtctcgcaagatgagtttcaacagcaaattgcacgaatcaatagccacgaagttcaagaacttgggatggaaagtgttttggctaatgcttatacttcaccgcaaaataaaaaagccattcgacaagtaatgaaagttgtcgatgacattcaattagcaatgaatggacaggcaccaacctcgatttcaattgaatttactcgaaaacctgaagaaaatagtgaaattagcaagtctagatatgaaacaattacctcaatttatcaatcactttctaaagatattgaaaaagaggtgaaggataatctaaataagaacaagagcagtcttaaaaagaatctgtcagataaatactatctgtactttacacaattaggacgcgatatttacacaaatcaacccattccatttaatgaaattccttattatgacattgatcatattgtgccacgttcagttgaaatgaatgattctttaaacaatcgagtactagtagcgaaaagcattaaccaaatcaaaaaaaataatgcacctatcgatagttcattgaagataacaagtgaaacacgtcagttgtggaaaaaattattagatagtggcttaattaccaaacaaaaatattataaattaagcagtagtattaagaatacggttagtccttacgttaaacagggcttcattaatcgtcagttggtagaaactagccaagttatcaaattggttgctaatattttgggaactaagtatcaaaatgatgatactgaaattattgaagttaaagcccatttaaactctgaaattcgtaagacttttgagttctataaacttcgagaacttaatgactatcatcacggattcgatgcttatttgacaacacttgttggtggttacttatataatcgttatcctaagttaagaagctattttgtttatggtgatcataagcgtttagataaagcacaactttctgaacttaaaaactttaacttcttacatggcttgactaatccaaagtctggttcagacgggttaattactgcatctggctcacaacaagttgtgttagacagaaatgaaacgatcaaaagattaaacaaaatttatcgatacaaatatatgttaatctctcgtgaagtatttactaaacaaggacaattctataacgagacgatttatccagcaaaacctaatacagctaaaatgatacctttgaaagacaacaagccaagtgaagtctatggtggatattcaagtagtaacgtttctaagattgctttgataaaggaaaagaatactgataattatcagtttattggtattccaattcgctctattgctaaattaaagcaagcaaaagccaatagtaaaacagtttatcaaactgaactcaatcgagtgattaaatctgtattagctagtcaaaaaactaaaaagcaaaaagaatttgaagttatattggataacgttaaatataaccaagtggtggttgatcaaggagagaaatactatctaggaagtccttactataaaaagaatgcaaaacagttagtgattagtcctgaatcggttaaaatattggctgataaagcaactgcagacttacctgaacaagaggctcacaacaaattaatgacagtttatcaagagattgtagacgtattaaataagcattttgctttatatgatataaataatgttcgaaaaaaattaaatgacggattaattaaatttagccaattgccaaattatgatgaaacatcaaaaaatagatttgatatttctaagtcaattaagactaagtatgctgttattatgagaattttgagtggtattaaaaatcaaacaagcgaggttccagaacttggcttaaaatctccgttaaataagatgcaaacaaaaggtggtataaaaatttcacccgaagctaaaatatattactcatcaccgactggaatttttagtcactttaaacaagttaaaaatctataa

SEQ ID NO: 316 - DNA, 4095 bp, Lactobacillus fuchuensis DSM 14340
atgaataagcgatataatattggattagatattgggaccaattctatcggctggtcagtggttaatgatcaaagtcagttagtcagaattaagggaaaattagggtacggtgttcgactgtacgatgaaggtcaaacagctgaagaccgacgactgtttagaacgacgcgccgccgcttaaaacggcgtaaatggcgcttaggtttattacgcgaaatttttgaaccttacatcacaccgcaagatgcgacttttttcttaagacagaaacaatcgaatttaagccccaaggatttacaaaaacagcagccacaaattggtttatttaatgatcgtttggacagcgattttcactatcaatatccgacaatttatcatttgcgctacgcgttaatgactgaaaagcggcaatttgatttacgcgaaatttatttggcgatgcatcacattgtcaaataccgggggcattttttgaacgcagctgccgcgtcatcttttaaaagcggagaaattgatttagctaaggatttcgcagcgttaaatcagatttttggaacaatctttagtgaagtcggcttcagtttatcagaaagcaatttagatgagattaaatcaattttgttggataacaatttaagcgctagtgtgcgccaacgcaaagcactaccgttaatttaccaaaccgctgcttcaaaagattcggaaaagcaatataaagcaattgcaactgaattattgaaagcgattctaggcttaaaggcgaaatttaatctcatcacaggtatcgaagtcgaagatgtcaaagcgtggacgttaagttttaatgctgaagattttgatgctaagttgagcgacttaaatattgcggataatgatgacgccgtacaaatcattgaaattttacgagctctttattcaggtgttttactgactgggattgtgcctgagggacaatcaatttcacaggcgatgattgataagtatgaagcgcataaagcacatctgataatgttgcggtcaattcgcgaacaattatctgataaagaaaataaagcacttgaaaaggcatatgatgactatattgatcatccggaagataagcagcacggttcacgtgaggatttctatgcggcaatcacgaaagtattaaaaaaagattcagaggatacaaatattatcgaaattctaaaattgattgaattggatcagtttatgcctaaacaacgcactaaggacaacggcgccattccacaccagttacatcaacaggaattggatcaaattattgaaaatcaaaaacaatattatccttggttggcggacattaaccccaatgaacaacggcaaaaaatggcgccctataaattagatgagttggtgacattcagagtgccttattacgtcggcccgatgattacggctgaagaacagttccaaacttctaataaaaaatttgcatggatgattcgtaaagaaccaggcgcgattacgccgtggaattttgatcagaaagtcgaccgccaagcttccgcgaatgaattcattaaacgaatgacaaccactgatacttatttgttggccgaagatgttttgccaaagcaaagtttgttgtatcaacggtttgaagtattaaatgaattgaatggcattaaaattgatgatcaaccgattacggtcgaacaaaagcaagccatttttaacgataaattcatgcaacaagcgcatgttacggttaaaaatattcaagcttatctcgtctctgaggggcagtatgcgagtcgaccaaacattacgggtttgtcagatggtgagaaatttaatagtagtttgagtacttaccatgatcttaagaaaatctttggggatatgattgatgaccctaataagcaaaccgattttgaaaaaatgattgaatggtcaacgatttttgaggatggcaaaatatttgctgataaattacgtgaaattaattggttaacagacgaacaacgccagcgactatcgaataaacggtaccgtggttggggccaattatcgactaaactattaaccaaaattgtcgatcaaaatggtcaacggattatcgatattctttggaataccaatgacaattttatgcggattattcattctgatgattttgatcaggccgtgactcaagctaaccaaatgttattagcggataatgatacgcaagatgtaattaacgagttatacacgtcaccttccaataaaaaagctctacgacaaatattactagtcgtggccgatattcaaaaggcgatgaaggggcaagcaccggctcggattttaatcgaatttgcgcgtgaaaaacaagctaatccgcgattatcaacacaacggcgtcgccaagttgaacaagtctatcaagagctaaataatgatcagctcaacaaagaattggccgatccacagtatgctaatttatcgaaagatcgactattcttgtatttcatgcaaggcggtcgggatatgtatacgggtgagtcgttaaatattgatcggttatcggagtatgatattgatcatattttaccgcaagcctttatcaaagataattcgttggataaccgggtattagtatcggcaaaaatgaatcggagtaaatcagaccacgtaccgcttgattttactgaagaacgatttgggcaaaaaatgcgcagtcagtgggaacaaatgttacgggccggtttgctgacgcgccgtaaatataataatttaacgttaaatccagatagtctcaataaatataccatgagtggctttatcaatcgccaattagttgaaacccggcaagtgattaaactcgcaactaacttattagtcgatcaatatgccgatgaagacgtgcagttagtgacggttaaaagtggcttaacccaccaaatgcgcgaagattttgattttcctaagaatcgaaatttaaataattaccatcacgcttttgatgcgtatctaacggcttttgtgggcctctatttactgaagaaataccctaaattggcccattatttcgtctacggtcaataccaacaaggttttaaggccaatgaccagtggcgtaactttaattttctaaatggtttacgtcaagagcaacaggtcgatgctgaaacgggtgagcttatttggcaaaaagaccatgatttagcttatatgaataaaatctatgatttcaagaaaattctggtgacgcgtgaagtgcatactaatcacggcgcgttgtataatcagacgctctataaagctaaagatgacaaagcgagtggtcaaggtggtcgtcaattgattgcagctaaagaaaaccgaccaacggcaatttatggtggttattctggtaaaacagtcgcttatatgtgtttagtgcgaattactgaaaaaaagggtgatttttatcgtatttgtggggtgcaaacagcttgggttgatgagctagaacacattgaagacgcaacgattaagctgcaaagattgactgcattattaacgcctcaattttccgcgactaaaaagcaaaaagatgaagttgtgacagtcgttaaaccattcgaagtgctcttaccgaaaattttaattaatcaacggttctacgacggtggccaagaactaacattggcatcggcaacttataaaaataatgcgcaagagttagtacttgataaaaaagccgtgcaagtgttaaatggccaattgccaaaggctgagttggaggcacaggcaacagttgtttatgatcaaatattagaacgagttcagaaatatttcccactgtatgacatgaatagttttagagagaaattatttgtaggacgtgataaatttaacgaattaccatggcaggatcaatgggagaatcataaattaattcaggtgggacaaaagacaattttagatcgaattttgattggattacatgcgaatgcagcgatgggggatttaaaagcactaaatatgtctacgccgtttggaaaacttcaaaaatctaatgggatatcgcttagccctgagacccaaatcatctaccaatcaccgaccggtctgttcgaacgacgtgtggctttgaaagatttatag

SEQ ID NO: 317 - DNA, 3390 bp, Lactobacillus futsaii JCM 17355
atggcagatagaatcagtttaggtttagatattggtgtggcctcggttggattcagtgttttggacatcgacaagggtaaagtcatcgaattaggttctagattattcaatgcaactgttgctgaaggtaatcaagaccgccgtagtatgcgtggtgctagacgattattgaatcgtaataaacaacgtcgccaagatactggtaagttatttcaaaaatttggcttgttagacaattttaacaaggataatttttatgatactttcaatcaaaattggaatccttatgaattaagagttaagggattaactgaacacttaactaagaaagaattggctgagagtttgtatcagattgtcaaacatcgtggtattagctatgccttaaaggatgccgatgctgatgaaggtggaactgactattcagctagtttaaaaatcaatagtcaagaattggctgagaaaactcccgctcaaattcagttacaacgtctaaatgattatggcaaagttagaggacaagtagttattggagatgatcctgataatcaaaaagtattattaaatgtctttccaacgagtgcctatgaaaaagaagctaagcaaatcattgctactcaaaaacaattttatccagagattttgactgatgagtttactaaagaatattgcaaaattttgactagaaaaagagattattttgttggaccaggtaatgagaaatcacgaactgattatggaatttataaaaccgatggtcgaactttggataatttattcgaagagctaatcggtcacgataaaatatatcctgacgagttaagagcttcggctgcatcatacactgcacaattgtttaatgttttgaatgacttgaataatctaagaattttgagttatgaagacggtaagttaactaaagaagacaaagaaaaaatcattgccgaaataaagagtaatacgacaacgataaatatgttaaatgttattaaaaaagttgctggttgttcaaaagaggacattaagggatttcgtgtcaacgaaaaggacaaaccagaaatcagctcaatggcggtttaccgtaaagttcataaggacttactcaaggtaggggttgatataagtgattggccggttgagtttatcgataagttaagctttattttgaccttaaatactgagaatggtgaaattagaaaacaacttaataatcgattagtcccagaatttgattttttgaatgatgatttgattcaattgattattgataataaagatagttttgaaattaaaactaataataaatggcatcgtttctcattgaagacaatgaataaattgatgcctgagatgcttgaacgtcctgttgaacaaatgactttgttgaatgaaatgggtttggttaaaaaggataagaaacgttttgaaaataacaagtacttgccttacaaagaaattgcgaaggatatctttaatccagttgcgtctaaatcagttcgtgaagctttgaaaattgttaatgcagttctgaagaaatacggacacattgactatttagttattgaaatgccacgtgataagaacttaaaagaagaacaagataacattaaagaatttcaaaataaaaataaaaaggccaaagatgctgctttcgaggcctttgttaaatcagtcggtagtgaacaaagagtaaaagaagctttgagtaagaaccgtaaattacaaatgaaaatgcgtctgtggtatcaacaacaagaaattgatccatataatggtgaaacaatcgatgctactgatttaatcaataatcctgataaatttgaaattgatcatattattccacaatcgatttcttttgacgatagtatcaataacaagaccttgtgttttgcttcgatgaatcaagttaaaggacaaaaaacaccttatgaattcatgcttgaaggtcatgggcaaggttatgacaaatttaaggctactgttttagataataaaaacttcgacagaaataaacgtaagaattatctctttgaagaaaatgtcagtgatattgagacaagaaagagattcttatcacgtaatttagttgatacgagatattcttctcgagtagtacttaatagcttgcaagatttcttccatgaaaaatcagctgatactaaggtaacagttattcgtggtaaatttacctccaacatgcgtaaacattggcacattgataaaactcgtgaaactttccatcaccatgcgattgatgcctcaattattgcagctactccgtttttgagaatgtggaaaaaaggtggcacaattttcccagttaaggttggtgaagaatcaatcgatattgaaactggcgagattttggacgataaaaaattcgataaagtgatgtatgaggaaccttataatggttttgtttctgaaatcatgaatgcagatgatcgaattaaattctcacaccaagttgataaaaagatgaatcgtaaagtaagtgatgcgacaatttattcaactcgaactggtaaattagctaaagataaaaaagatgctgagtatatcgtagctaaagtgaaagatatttatagtgtcgatggctttaagaagtttaagaaagtttatgataaagataagtctaagttcttattgtataagtatgatcctagaactttctccgagttagaaagaatcataagcgactgtccagataaagttgaaaaagtacaaacaaatggaaaggtcaaggccgtggatgtaagtccatttgaaatgtatcgaagataccatggaatgattaagaaatattctaagaagggtaatggaccagccattaaacaacttaagtatcttgataagaagctcggttcacatattgatatcacaccagctaatgccaatggtaaacacgttatccttcaatcgttgaaaccttggagaaccgatgtttatttgaatcatgaaactggtgaatatgagattatgggaattaagtattctgatctgaagttcaataagaatgtgggatatggaattaagaaagataagtatttggaaattaagaaaaatgaggaagtatcggaaaaatctgagtttatgtttagtttatatcgtaaagatagagtcaggattcaaaatatgaaaactggtgaatcagtggaattattattctggtcaaggaatttttctaataaaaagtatgcagaattaaagccaatttttaaatttgtgacggaagatgatgattggccagtatatgggcatgcaaaaacacaaatattgaaacgattagtgccaaaagattgtaagatttggaaagtaaatacgactattctaggagatccatactacttagaaaaagaatccgataatccaaaagatatccttgattaa

SEQ ID NO: 318 - DNA, 4161 bp, Lactobacillus gasseri K7
atgaccaaaataaaaaatgaatatattgtgggcctggatatcgggactaattcgtgtggctgggtagcaatggattttcaaaatactattctacgaatgcatgggaaaactgctattggttctcatctatttgatgcaggaaattcagcagctgatcgtcgtgcttttagaacaacacggagaagaataaaaagaagaaaatggcgcttaaaactactagaagagatatttgatccgtatatgacggaagtagatccttatttttttgctcgtttaaaagaatctggtctttcacctttagataaaaggaaaaatgcatcttctatagtttttcctactgccttagaagataagaagttttattgcaattatccaactatatatcatttgcgttatgacttgatgagtgaagataagaaatttgacttaagagaaatttatcttgcaattcatcacattgtgaaatatcgcggtaattttttatacaatacacctgttaaagacttcgaagcttcaaaaatagatgtaaaagatagtttggagaaattaaatgagttatatgaaagattagactcagaatttactgtagagcttgatagtagtaatgcattagaaattgaaaaaattattcgagataagaatgtttttaagataaataaagttaagtcaattcatcaattactttctttaaaaactgagaataaggagcgtactaagttaataaaagatgtttctaagcaaataataaatgctattttaggttacaaaactaaatttgaaactattttgttaaaaaacattagtaaagatgaagcagacgactgggaatttaagcttactgatgtggatgcagataataagtttgaaaatctaattggggaccttaatgaaaatgaacaagaaattctgttagtaatcaggaatttggctaacgcaattactttaagtaacattgttgaagagggaaagactttatctgaatcaatgatcgataagtataataagcattcagatgatttgaaactattgaaacaagttatttcagatcatcctgatcgagataaggctaagaaattagccttggcttatgacttgtatgtcaacaatcgtcatggaaaacttcttcaggctaaagatgtcttgggaagtaagaaaactttatcaaaagaagatttttataaagaagttaaaaagaatctagatgattcaaaggcatcacaagaaattttagatgcaattgccttagattcatttatgccaaaacagaggacaaatgaaaatggtgtaattccatatcaacttcatcagcttgaattagatagaattattaaaaatcaaggaaagtactatccgtttttaaaagaggcaaatcctgtttcttcacatttaaagcaagcaccatataagcttgatgaactgattagatttagagttccttattatgtaggaccattaatttcaccaaacgaatctacaaaaaataaacaaacaaagaaaaatcaaaattttgcctggatgatacgtaaggagcaaggtcaaattactccttggaattttgatcaaaaagtagatcgaatggcgtcagcaaacaagttcattaaacgaatgacaactaaagatacttacttattaggtgaagatgttttaccagctaatagtttactttatcaaaagtttacagtattaaatgaacttaataacataaaaattaatggtaaaagaatatctgtgcctttaaaacaagaactatataataacttgtttaagaagaattcaacggtaactaccaataagcttaaatcctatttgaaagagaattataatcttattaatgttgaaattaagggattagcagatgaaaagaaatttaattctggattgacaacttataataaattaagaaatttgaagatttttgatcaacaaattgatgatcttaactatgataaagattttgaacggattatcgaatggtcaactatttttgaagataaggctatttataaagataaattgaaaactataaaatggctcagtgatagacaaattgataaactaagcaagattagaatgcaaggttggggtcaattatcgaaaaaattattatcacaattaactgataataatggtcaaactattattgaacaactttgggatagtcaaaataactttatgcaaattgtaaatcaggctgattttaaagatgctattgcagttgccaaccaaaatttattagttaataccagtgtagaagacattttaaatgaggcttatacgtcaccagctaataagaaagcaatccgccaagtcgttaaagtggttgatgacattgttaaagcggcctcaggaaaagttcctaaacaaatcgcaattgaatttactagagatgcagacgataaagctaaaataagtcaaactcgagcaaataaattgcgcaaagtttataaagaattatctaatgaattagcatcggaggctattagaaatgagttggaacgggttgctaaagatcaaaaattgttgaaagataaatattatttatactttatgcaacttggtagggatgcttatacgggtgaaccaattgatattgatgaactagaacaatatgatatagatcacattcttccacaaagctttattaaagatgattctctggaaaaccgagttttagttaaaaaagcagtaaataatggtaaatctgataatgtaccagttaaattatatggaaatcacatggcggctgacttaggaataacgattcgtcatatgtgggaaaaatggaaagatcaaggattaattactaagactaagtataataatttaattattgatccagataagataaataaatatgaatcttcaggcttcatacatagacaactggttgaaacgagtcaaattattaaattagcttcaacgattttgcaatctaagtatcctgatactgaaataatagttgttaaagcgcgatataatcattatttgcgaaagcatttgaatttatataagagtagagaagtcaacgattatcatcatgctattgatgcgtatctttcagctatttgtggtaatcttctttatcaggtttatccttatttacgtcctttctttgtatatggacaatataaaaaatttagttctgatcctaaaaaagaaaagataatttatgataaaacaagaaaatataattttatttcgcaaatttttgaaaacaagggtaacgatattatcagtcttgaaactaagaaaaaggtttttgataaaaaagatataattgaaaaattgaaacatgcatatgattataaatacatgcttgtttctcgagaaactgaaactcgcgatcaggaaatgtttaagatgactgtttatccgcgtttatcgcgtgatacaaaaaaatcacgtaatctaattcctaaaaagaaagatatgcctactgaaatatatggcggatatacaaataattccgatgcttatatggttattgctaggattaataagaaaaaggaaaccgaatatcgcgtgttcggagtaccaatgcgtgaattagttaatttaagaaaagctgagaaaaaaggtcactataatgcttatttgaagcaggtgcttgaacctgaaattatgtataacaaaaatggaaagaaaaataaaacaattagttcatttgaaattgttaaatcaaaagttccatataagcaagtaattttagatggtgacaagaagtttatgcttggaagttcaacatatgtatataatgctaagcaattaactttatctcaagatgctatgcaagcaattacagataattgtgaaaatgatacggatgaagagaaagctttgattgaagcatatgatgaaattcttacaaatattgataaatatttaccattatttgatattaataaatttagagataaattacatgctggaagagaaaaatttattaatttatcgttagatgtgaaaaaagatacaattttgcaggtgttgaatggattacatgataatgctgtaatgcctaaaattaagtctttaggattatctacggaattgggaaaattacagattcctacaggtgtaaaattatctgagaatgcaaaattaatttatcaatctccaacaggtctatttgaaaaacgcgttaagatttcagatttgtaa

SEQ ID NO: 319 - DNA, 4111 bp, Lactobacillus graminis DSM 20719
atgtatgaaacgttcgtataatattggtctagatattgggaccaattcaattggctgggcgattgttgatgatcaaagtaaactaatcagtgttaaaggaaaatatggttatggggttcgcttatatgatgaaggccaaaccgctgctgagcgccgtagtttcagaacaacacggcggcgcttaaagcggcgtaagtggcgcttgggattattaagagaaatctttgaaccctatatcacgccgattgatagcacttttttcttacggcaaaagcaatcaaatttaagtcccaaagatcagcgtaaattatatccgcaaacgagtttatttaatgatcgtccggatgccgatttttatcagcaatatccgacaatttaccacttgcgatatcagttgatgactgaaaagcgccagtttgatattcgtgagatttatttagcgatgcaccatattgtgaagtatcgggggcacttcttgaacgaagcgccggttgcctcatttaaaagtagcgaaattaatttagcagagcattttgatcagttaaataccatttttgctgacttatttagggagtccggctttcaattagagactgatgaattggtagcggttaaggcccttctaatggataatcaacaaagtgctagcaatcgccaacgcaaagcgttaccaaagctatacacgccaagtgcggataagtcgattgagaagcaacgtaaagccattgcaactgaaatattaaaagccatcttaggattaaaggcgaagtttaatgtggttactgggattgaagctgaagatgttaaagcatgggcattgacttttaacgctgaaaattttgatgaagaattggctaagctcgaaagtagtctcgatgacaatggccacgaagttattggtatcttacaggaactttattcgggaatcttactggccggaattgtccccgaaaaccagtcattgtcacaagcgatgatcacaaaatatgaagaacatcaagcacatttaaaaatgctaaaagcagtgcgagatgatctagcaacagcagatcaacaaaaactaaagaaggcttatgatcagtatatcgatggtcaagaaaatacgaaggcctattcgaaggaagctttttatgacgacgtcacaaaagccttaaaggattattcagaacaaccgctcgtgagtgaaattcaaaaattaattgagcttgatcaatttatgcctaaacaacggaccaaagataatggggcgattccacaccagttacatcaacaggaattagaccggattatcgagaaccaacagcaatattatccatggttggcagaactcaatcccaatccgaagcgccaaaccgttgctaagtacaaattagatgaattagtggcatttagggtaccgtattacgttgggccgctcattacagctgagcaacaacaacaaagttcaaatgccaaatttgcatggatgattcgtaagactgaaggccgcattacaccatggaacttcgatgataaagtggaccggcaagcatcggcgaatgagtttattaagcgcatgacaaccactgacacttatttattggccgaagatgtattaccaaagcaaagcttaatttatcaacggtttgaagtattaaacgaattaaatgggcttaaaattgatgaccaaccgattactaatgagcttaaacaagcaatcttcaatgatttatttatgcaaaagacaagtgtatcagtgaaaaacattcaggattacttggtatcagagaagcgctatgcaagtcgccccgcaattactggtctatctgatgagaaaaaattcaatagtcgattaagtacgtatcatgacttaaaggtgattgttggggatgcggttgatgatgttgataaacaagctgatttggaaaaatgcattgaatggtcaacgatttttgaagacggtaaaatttatagtgctaaattgaatgagattacatggttaacagaacaacaacgggggcaactagctactaaacgctaccgcggttggggtcgcttgtcggctaaattattaacgcaaattgttaatgcaaatggacaacgcatcatggatttactctgggatacaaccgacaacttcatgcggattgttcactttgaggactttgacaagttaattactgaagccaatcaaatggtgttagctgaaaatgatgtgcaagatgtcatcaatgatttatatacgtcaccacagaataaaaaagcgctccgccaaattctacttgtggtcaatgacattcaaaaagccatgaaagggcaagcaccagaaagaatattgattgaatttgcgcggggggcacagaaagataaaagtttgacagttcggcgtaaaagaaagctagatgagatgtatagccaaataagcgatgctgtacttgcagatgaaagtgttcggcaagaactgaaaagtagtaatcaagatgacttagttaaagagaaagtgtacttatacttcatgcaaggaggacgagatttatataccgggaatgcattaaatattgatcgtttgtcggactatcatgtcgatcatattattccccaggcttacattaaggatgattccttggataataaggcgctagtatcatctagaatgaatgagattaaagccgatcgagttcctcttcaggtagttcagaagcaatttggcaaaaatatggcttctgaatggggctacatgcatcgagcaggattaattagtcggaaaaaatatgataatttaatgttcaatcctgaaaacctaaataagtatcagattaatcgttttattagccgtcaactggtagaaacccaacaagttatcaaattggtagcaaacttattgagtaaccagtatgaaggtgataatgtcaaaatcattacagtcaagagcaagttaacacagacgatacgttctgaatttgattttcctaaaaaccgagaggtcaataattatcatcatgcttttgatgcttatttaacagcttttgtggggatgtatttattgaaacgctatccaaaactaagttcatactttacttatggcgaatatttaaaaggaaatcaacaggataagtggagtagctttaatttcttaaatgatttaaagagggctaaattagaagataaaactaataaggaaatcttttggcataaagaatccggcctagcttacttgaataaaatttatcagtttaagaagattttagtgacccgcgaagtgcatgaaaattcaggagcattatttaatcaaacactctatgcggctaaagatgataaagccagtggtcagggcgggaagcaattgattcctgctaaacaagcccgaccaactgcgctctatggtggatactcagggaagactgttgcctacatgtgtatcgtacgcattaaaaataaaaagggtgatctctataaagtctgtggtgttgagacaagttggctagcacaacttaaacaactgaaagatgaagactcacaaaaagcattcttaaagcaaaaaattagtccgcaatttacaaaagcgaagaaacaaaaaggaacgattgtgaaagtagtcgaagactttgaagttatcgcaccacacatcttaattaatcaacggctctttgataatggtcaggaattgacattgggttctgcgacgtataaacacaatgagcaggaactgattctcgacaaaacagccgtcaaattgttaaatggtgaattgccattagcgcagtctgaagaacttgctgaactagtttatgatgagattttagatcaagtgatgcactacttcccattgtatgatacaaatcaatttagagctaaattattagcgggtaaaacggccttcatgcagttaccatggaagagtaatcctgatgataataagacagtacagattactcagccgatagtgttgaaaaaaattctacaaggactgcatgctgatgcgggacgtgtatcgttaaaagaattgggaatgaccactgattttggaatgttgcagaaggctactggtattacattcacacctgacacccaaattatctatcaatctccaaccggtttattcgaacgacgagtagctttaagggatttataa

SEQ ID NO: 320 - DNA, 4152 bp, Lactobacillus hammesii DSM 16381
ctgctggaagactttctagtgggtgtagaagtgtttcatagaaaaataggaggcgttatcgccatgaatcaggaaccatatgcgattggattagatattgggaccagctctttgggttgggctaatgcagacatggatggttatattgcccgagtgaagggacaaaccggattgggagtccgtctattcgaagaaggacagcccgccgcggatcgtcgaagctttagaacgacacgtagacgtttgagccgccgccgttggcgtttacggttattacgtgaaatttttgatgagccaatttcatccatcgatcctaacttctttgcgcgtcagaaggcatcgagtatttcgcctaaggatgatcgatttgagacaacttatcaattgtttaatgataaaactgatcaagagttttattcaaagtatccaaccatctatcatttgcgatgggcgctgatgacggagcatcgcaaatttgatttaagagaaatttacttagctgtacatcacattgttaagtaccgtgggaattttctgcgttctggaaaccccaaaagttttaagccaagtgaattagatttttcacaacggtttaaagaggttaacggactatggcatcttatctttgatgaggtggcaccacagttgcctacggacaacttggaagaaattacgaaactggtattagatacaacgcgcactcgagccgatcgtcagcgagagtcggttaagctgttaatggcggcgacagataatcataaggactggaagccgtatctaactgaatttactaaagcaattttaggcttgaaaacgaaactgtatctacttacaggagttgacgttgcaaaagcggatcaaaaaacttggacgtttagtttagaggacattgaagatcatcgggcagatttagaaacggcatttgatgaccggagtctggaattaattgaaaagttagttgatttacaagcagcaattcaactgactgaaattatgcccagcggacagtacttctcacagagtatgatatatcgatatgatcaacataaggaacatttacggtggttaaaggattatgcagaacagcaaacagatgctaataaaaggaaggctgtccggctagcttatgaccactacatcgagggagatgccaaaggaaagcctgaaattgctgatgacttttataaggaactgaatcgaatcctgaaaggcgacacgtcagaactcgctaaaaaaatcaatcatgagatcgcgttggagcattttatgcctaaacagcgaacaaaagaaaatggtgttattccctaccaaattcatcaacaagagctagactcgattattgataatcaaaagaaatattatcaatttttaggagaagataatccggtggtatctcatcatgggtcacagccatataaaattgatgagctagtgagtttccgggtcccctattatgttggccctatgatcacggcagaccagcagaaaaagacggcagcaggacaatttgcatggatggttcgtaaagacagtggtgatattacgccctggaactttgatgataaagttgaccggaccgcttcagcaacaaactttattcaacggatgaaaaccacggatacttatctgattggggaggacgtgttaccactacagagtctgacttatcagaagttcatggttctcaatgaattgaataatatccgaatcaatggcgaattgctgactcgtgagcagaagcagcgaacctataacgatgtcttcaaaggtcatggaacagtcaacgtaaaatccttaattaagagtttagaatgtcacagtgaggtcactggtgcgatcaaggtggaagggctagctgatcctaaacgttttaatagtgcgttaaccacatatcgtgactttaagaaaatcttaccagtagcgattgatcaaccgcaacgtcaggcggatatcgaaaggataattaattggtcaacgatttttgaagatgccgatatcttcaaagcgaaactacaagagatcgattggctgacagatacgcaacgtgatcgcctcagtactaagcgttatcgtggctggggacgtttgtcagccaaactattattgaatattaaggatacgcaaggtttatcaattatggaccagctatggaatacgcaacataatttcatgcaaattgtacatgagccagattatgcagagaagattgaaaagacgaatgccaaggggctgaaacaacaagatatatttgaaacaatcaacgaaatgtacacatcaccacaaaacaaaaaagctttgcgtcaaatcttagcagttgttcgtgatattcaaaaagcccatcacggtcaggcgcctagtcgaatctttattgaagcggcgcgaggagcagagcagaatcctcagcgaacgcggcaacgtcagaaacaattggcagatttatttgctgatcaagctaaagaaattgtcaatgaaacagtagctcaggagttgaatgatgagactgacaacaaggcacgattcacggaccgactcatgttgtatttcctacaaaatggtcaggatatgtatacaggagaaaaactgaatattgataaattatcgacctacgatattgatcacattttaccgcagtcgttagttaaggatgattcgttagataatcgtgtgttggttagcaaggtagagaatcttaaaaaaaatgatcattttgcctcagagctttatgccagaaaaatgcaaggaacatgggaactatggcggtcagcagggctaattagtgcgcggaagctgaaacatttattaatgcggcctgatgaaattaataaatatgctaccggatttatcagaagacagctggtcgaaacccgccaagtcatcaaattagtcacggatgtattgagtaatgaatatgattcagacaaaactaagattatttcagttaaggcgggactttctcaccagctacgaatggagctggacttgccgaaagttcgggagttgaatgactatcatcatgcttttgatgcctttttggcagttcgaattggaacctacttactaaaacgttatcccaagttggaacgtttctttgtttacggtcaatatcaggtagcgccacaattggacttacgccgttttaatttcattcatgacttggtttccggaaaacaagagaagatagttgccgaggagaccggcgaaattgtgtggaatcgtgagaaagatgtttcttacatgaaacatcttttgagcttgaaacatttgctggtgacacatgaagttaaggaagatcatggggccttgttcaatcaaaccatctataaggcaaaaaaggataatggcaatgttggcggtaagatgaagctacttcctactaaaagtaatcgaccgacagaaatttatggcggacattctagccaagcaatagcttatttagcaattgtcagagttaatggcaaggaaccttcgtacagagttatgggagttccaattaggattctcgatcagctgaagcaagctaagaagcagggagaatatgctgaaaggttagcgttaaagcagttctttacaccggactttactaaaggtaaaggaaaaattgtttcggactttgacgtagttattccacatattcccctgttacagcccgtgatagatgagatttcaggacagtcacataggtttgctttagggactaatacctattatcgaaatttacagcaattgattttaacgcttgctgatcaaaaggtattaatttcaaaagagacaggagtggatgaagagaagaagctcgtagaagtctattctcacatttgtcagcaagttatgaagtttttcccgttatacgatcggaataaatttagggaactacttgtagacagtcgatcccatttcgaacaattaccaattgttaatcgttattcagatgctgggaaactagagatagctggcaagcggggcattttacaacagataatggttggattgcatgccaacgcgacgcctggggatttgaaagaactaggcgtaaaaacgccttttggaaagctacaagttccaggcggcattaaattaactgagaatgctaagctgatttatgaatcgccgacaggcttgtttaaacgggaggtgaagataactaccgagtaa

SEQ ID NO: 321 - DNA, 4161 bp, Lactobacillus hominis CRBIP
atgacaaaaataaccgaagactatattgtgggcctggatatcgggactaattcttgtggctgggtagcaatggattcaaaaaatactattctgcgaatgcatggaaaaactgctattgggtctcacttatttgatgcaggaaattcggcagctgatcgtcgggcttttcgaacaacacggagaagaattaaaagaagaaagtggcgattaaagttattagaagagatatttgattctcatttggcaaaagttgatccatacttttttgctcgtttaaaagagtctggtctctcacctttagatacaagaaaaaatgtatcttcaataatttatccaacatctcttgaagataagaagttttatgttgataatcctactatttatcatcttcgttacaagttgatgactgaagatcgaaaatttgatttaagagaagtttatcttgcaattcaccatattgtgaaataccgcggtaattttttatataatacgcctgttaaagcctttgaagcttcaaaaatagatgtaaaaggtagcttaaagaaattaaatgagttatatgaaggattagactcagaatttaatgtagaacttgatagcaataatgcattagaaattgaaaatattattcgagataagaaaatcttcaagataaataaagttaaggaaattaaccaattactttctttaaaaactgaggataaggaacgtactaagttaatgaaggatgtttctaagcaaatagtaaatgctattttaggttataaaactaaatttgaaactattttattaaaagatgtaagtaaagatgaagcagacgattgggagtttaagcttactgatgtggatgcagataataagtttgaaaatctaattggggatcttaatgaaaatgaacaagaaattctgttagtaattaggaaattggctaatgcaattactttaagtaacattgtcgaagagggaaagactttatctgaatcaatgaaggataagtataagaaacattcagatgatttgaaattattaaaacaagttatttctgatcatcctgatcgagataaggctaagaaattagctttggcttatgacttgtatgttaataatcgacatggaaaaattcttcaagctaaagatatattagaaaagaagaaaactttatcaaaagaagatttttataaagaaattaaaaagaatctagatgattcaaaggaatcacaggaaattttagatgcaatttccttagattcattcatgccaaaacagagaacaaatgagaatggggtaattccatatcagcttcatcagcttgaattagacaaaattattgaaaatcagggaaagtactatccgtttttgaaagaggtaaatcccgtttcttcacatttaaagcaagcaccatataagcttgatgaactaattaggtttagagttccttattatgtaggaccattaatttcaccaaacgaatctactaaaaataaacaaacaaagaaaaatcaaaattttgcttggatgatacgtaaggagcaaggacagattactccttggaattttgatcaaaaggtagatcgaatggcgtcagcaaacaagttcattaaacgaatgacaactatagatacttacttattaggtgaggatgttttaccagctaatagtttactttatcaaaagtttacagtattaaatgaacttaataacgtaaaaattaatggtaaacgaatatctgtgcctttaaaacaagaactatataataacttgtttaagaagaattcaactgtaactactaataagcttaaatcctatttgaaagaaaattataaacttattaaagttgagattaagggcttatctgatgaaaagaaatttaattctggattgacaacttataataaattaaaaaatttgaagatttttgatcaacaaattgatgatcctaactataataaagatttcgaacggatcatcgaatggtcaactatttttgaagataaggctatttataaagaaaagttgaaaactatagactggctaagtgatagacaaattgacaaactaagcaagattagaatgcaaggttggggtcaattatcgaagaaattattatcacaattaactgacaataatggtcaaactattattgagcaactttgggatagtcaaaacaattttatgcaaattgtaaatcaagctgattttaaagatgctattgcagttgctaaccaaaacttactagttgatacaagtgtagaagatattttaaatgaggcttatacgtcaccagctaataagaaagcaatccgccaagtagttaaagtggttgatgatattgttaaagcaacttcaggaaaagttcctaagcagatcgcaattgaatttaccagagatgcagacgataatgctaaaataagccaaagtcgagcaaataaattgcgtaaagtctataaagaaatgtctaacgaattagcgtcagaaactatcagaaatgaattggaacgggttgctaaagatcaaaaattgctaaaagataagcactatttatactttatgcaacttggtagggatgcttatacgggtgaactaattgatattgataatctagaacaatatgatatagatcacgttcttccacagagctttattaaagatgattccttggaaaaccgagttttagtaaaaaaagcagtaaataatggcaaatcggataatgtaccagttaaattatatggaaatcgtatggcaactgacttaggaatgacgattcgtcatatgtgggaaaaatggaaagagcaaggattaattacgaagactaagtataataatttaattattgatccagataagattaataaatatgaatcttcaggcttcatacacagacaactagttgaaacgagtcaaattattaagttagtttcaacaattttacaatctaagtatcctgatactgaaataatagttgttaaggcgcgatataatcattatttacgaaagcgcttgaacttatataagagcagagaagtaaatgattatcatcatgcaattgatgcatatctttcagctatttgtggtaatcttctttatcaggtttatccttatttacgtcctttctttgtatatggacaatataaaaaatttagttccgaacctgaaaaagaaaagataatttatgataaaacaaggagatataattttatttcgcaaatttttgaaaataaggataacgatattatcagtcgtgaaactaagaaaaaggtttttgataaaaaagatataattgaaaaattgaaacgtgcatataactataaatacatgcttgtttctcgagaaaccgaaactcacgatcaggaaatgtttaagatgacggtctatccacgtttatcacgtgatacaaagaaatcacgtaatttaattcctaaaaagaaagatatgcctactgaaatatatggcggatatacaaataattccgatgcctatatgattattgctagaattaataagaaaaagggccccgaatatcgcgtgttcggagtaccaatgcgtgaattggttaatttaagaaaagctgagaaaaatggtcactataaggcttatttaaagcaggtacttgaacctgaaattatgtatagcaagaatggaaagaaaaataaaacaattagttcatttgagattgttaaagcaaaagttccatataagcaagtaattttagatggtgacaaaaagtttatgcttgcaagttctacgtatgtccaaaatgctaagcaattaactttatctcaatattctatgcaagcaattactgataattgtgaaaatgataccgaagaggagaaagctttggttgaagcatatgatgaaattcttacaaatattgataaatacttaccattgtttgatattaataaatttagagaaaaattacatgctggaagagaaaaatttgttgatctaccattagctgagaaaaaagagacaattttacaggtattaaatggattacatgataatgctgtaatgcctaagattaagtctttaggattatctacgccattaggctttatgcaatttcatactggcgtatcactttctgaaaatgcaaaattaatttatcaatctccaacaggtttatttgaaaaacgccttaagatttcagatttgtaa

SEQ ID NO: 322 - DNA, 3900 bp, Lactobacillus hordei DSM 19519A
aaatggcgtttaggccttttggaggaaatatttgcaccatacttagcacagggggatccatattttttagcacgtatgaaggaatcaaatatttcaccacgagatgaacgcaaaaagtattatggttcactacttttttctgatgataccgttttttatgataaatatccaacagtttatcatttgagacatgccttaatgacagaggatagaaagtttgatattagagaaatttatttggctgtgcatcatattattaaatatcgaggaaacttcttaattaatactttgataaatgaattttcttccaaagcagttgattttaagaaagatgctgatatattaaacgatttatttgagcaattttatatttctgatattaacgattcttttcaattgaatactgctgacatgaatgaaattagtgaattattacttgataactccaaaactagacttgaccgtcagcgtgaaagtttaaaaaaactagcaaaaaaggtagatgatatatctgtcgctaaaaagcatcaaaaaattgcaacggaattcagtaaggcaattctgggaaataaagctaaatttgatgtcattttaaatgttactacagatagttcgaatgattggtcttttaagttagaagatgaggatgcagacgaaaaaatcgtcgttttgctggaagaattaaataccccacagcaggaagctttgaatattattcatcaatggtattcacagatttccttgaacggaattgttcccgatggaaaatcgatttcagaagcaatgattagtagctatgaactacataaagagcatctagcacttttaaaacagcagattaataatactaaagataaaaagaaagcacatggtttacatgaggcatataacgaatatgtacatggaaataataacaagaaactaaatcaagcagatttttattctaaggttaagcaaaatctagaatcatctttgattacggatgaaattctagaattgattaatgctgagaattttatgcctaaacagcgaacatctgctaatggtgtgatcccacatcagttacatcagcaagaattagacagaattattcaaaatcaagcaaagtactatccgtttttggcagaaactaatccgaatgaaaaacggagtaaggttgcaaagtataaattggatgagttagtagcctttcgtgtgccatattacgttggaccgcttattacagcaactgaccaaaagaaaacttcagggaaagaatttgcttggatggtacgtaaacagcctggtagaatcacaccatggaattttgatgagaaagttaacaaaatggagtcagcaaatacttttattcgacgtatgacaacaaaagacagttatctaattgcagaagatgttttacctgatgaaagccttctttaccagaagtttaaagtgttgaatgaattaaataacttgcgagctgatgggcgtaaactaaaagtttctgttaagcagaaagtttttaaagagttatttcagcaacaaaaaactattacaatagttaagttacaaaattatttaaaagctgagtgcagctttttaactactcctgagattagtggcttatcaaaaccagagcattttgtctccagtctagcgacctatattgatttaaaaaaaatttttggcgaagatattgataatcctgctagacaaaatgactttgaacgtatgattgaatgggcaactatttttgaagacaaaaatatttacagtgaaaaattaaatgaaattaaatggttaaacgataggcaaaaaaaagaattaaaaaataaaaattaccatggttggggtaaattatcagccaagctacttaaaggcttaagagattctgatgaatgctcaattattgagcatatgtggaatactcaacaaaactttatgcaagttcaagctgaagaagatttcgcacaacgaattcaagaagaaaataatcagcatttaaaaggaaatactttagaagaagttttggcagatgcctatacatctccgcaaaataaaaaagctattcgacaagtagttaaagttattgaagatattcaaaaagctatgggcggaatagctccgcaaaaaatatcaattgaatttactagagcgcccgaagaaaaaccgcgtcgttctgtcgagcgacagcagcaaattgaaaaaatttataaaagcgttgcaaatgaggtcgagaacgctggagtaaaggatgagttacaacgtttttctgacagaaaacagactttaactgataaatatttcttgtactttacccagcttggcaaagatatgtatactggtaagtcaattaacattgatcagattggtaattatcaaattgaccatattctaccgcaagcatttattaaagatgattcgcttgataatcgtgttttagtgagtgcagccgtaaataatggcaaatctgataatgttcccacaaaaaatgataggtataaagtgcgagaacatgggcaaagactgtatgatcaggggttgatatccaaacgaaaatttaataatttgataactgatcctgattctattaataaatttactgcaagaggatttgttaaacgacaattggttgaaacaagccaagttatccgactagttgctgagtttttgtataacaaatatcagagtaaaagtgagatcattgaagttcgagctaaaatgaattcacagttacgtaaggattttggattaatcaaaaaccgaaatgtcaatgattatcatcatgccttggacgcctatttaactacctttatcggaaattatctttatcggcgttatccaaaattgcgtgcatatttcacttatggatgctttaaaaaggttgatgattcccaattaaagtattttaattttttgcatgatatagaagatgataagaaaaagatcattaaggataatgatacaggagaaattctctggcatcgtgatgaaggaattgcacgatttaaaagaatttataattttaaatatatgctggtaacgcatgaagttttgactagacaaggtgcgatgtttaagcaaactgtatactcggccgcagtagcaggaagcaaaaaattgattcctgttaaagaggatcgaccaattgatatttatggaggatacaccaataataatgatgcttttctggcaatcgttaaagttactaagaaaaagcaatatatggtagttggtataccacaaagagcagtagttaaactgaatgatgccgcaaagcaaggtagtaaagcataccaaaaagttttatacaatgttataaaaccacaatttattaagaaaaagaaagatagaaaaaccggtaaaattacacaaaagttagagaattttgaaatcgtggtttccaaaactctatatcgacagctgattattgatggtgatcagaaatatatgttgggaagttcagcgtataaatataatgctaagcaactggtcttatctgagtatgcattggaagttttagatagaagtatttttgaaaaaaaagaatacacaactgttgatttagataatgtttacgatgaaattcttgcacaggtagacaaatatttttctttatatgacaaaaataaatttcgccagaaattacatgaaagtagaaagatttttactgaattaccaataaataatttattctcaggaacaaaattattaaaaagcggcaaacgtgagacgttgaatgaaatattggaaggattgcatgcaaatgcaactaagaaagatttaaaaagccttaaattttctacaccacttggaatgatacagtatccaagtgggattatactttcggaaaacgcaattctatgttatcaatctccaacaggaatttttgagcgaagagtgacacttaaagatttgtag

SEQ ID NO: 323 - DNA, 3513 bp, Lactobacillus hordei DSM 19519B
atgtcaaagtataatgtaggattggatataggtattgcatctgttgggtggtcaattgttgatgctgacaaaaagaaaattattgatttaggtagtcgtatattttcatcaggaaatgcagcggctaatcaagagcgacgtggttttaggggaacaagacggttgattagaaggcgaaaaaatagattaacagatgtaataaatttttttggagaaaaaaagtttatagatactaaagttgtagataaaaatggacatgtacattataaattttcagtaaataatacagaaagtccctatgaattacgtgttaaagggttatctgaaatattaacaaagcaagaacttgttattgcactttaccatattgtcaaacatcgagggatctcttatgatttaggcgatttggaagatgatggaacaagtggagtgaccgattataagacctcaattaatattaatcgacaattgttaaatgaaaaaacagttggccaaatacaactagaaaggctaaatgagtttggtaaagtccgaggacaggtagaagaaaatgaaaatgtaacattgctcaatgtttttccttcagcggcatatgtcaaagaagctacacaaattttaacgaagcaaagagaattttatccagaaattacggatgactttattgcaaagttcatgctgtttattactcgtaagcgtgattactttgttggacctggaaatgaaaagtcccgtacagattatggaatttataaaaaggatggccgaacactagacaatctttttgatgagctcataggaatagataagataaatggagagaaaagggcgtcagcatcaagtttgacagcgcagatatataatatgttaaacgacctgaataatttaacagtaccgaatactgaagatggaaggttaacaattcaaaccaaaaaagaaattcttgaagcagctaaaactacgaatggtttgtttggaatagctcaaatttgcaaaattataggttgtaaaaaggatgatattaaaggttttcgaattgataagtctgaaaagaaaattatgcatactctttctggttatcgaaaatttcgtaaagaacttgctgatgttaatatagaagcaaatgatttgaatattaatttagttaacaaaattgctgatatcctgacacttaatacagaaaaagctgaaattcgcaaacaattagacaaaagtaatatggatatctccaatgaaatgaaagagattgttattaataaaaataaggagtttttagtagatggtcgagcaacatggcatagtttctcctataaaacacttaatttacttataccggaattattaaatacacctgaagaacaaatgactattttgacacgcttaggtcttgtaaaacctaacaataaaaaatatgaaggcctgaagaatattcctgcacggagaattacagaagaaatatacaatccggtagttgctagagctactcgtgaagctgttaatgtttttaatgcaattaccaagaaagtaggacgtgacaatattaaggatgttattattgaattaccacgtgaagataacgaagtagacatcaaaaagggcattgtcaaaagacagaaacaaaatgaagtagaaaaagagacggctgatgcattagttaagcaacatatgacaatatcagatagtgcattaattgcacagtatcgtaaaattagaggactatcgcaaaaagtacggtattggtatcaacaggatacgatttgcccttattgcggtaagaaaattgaggctgttcaattaatcaataataatgatagttttgaagttgatcatattgtaccaatctcagttagttttgatgactctcaaaataataaagtcctggtacatagtcagtgtaatcaagcaaaagaaaaacaaacaccacttggttggttaaataatggtggtgggtttggtcaaagtaaagctgactatattgctagagtgaagtcaaataaaaattatgcaaaaaataagattgataatttgttgaatgagacagatcttaatgacattgctacacagcggggctttattcaacgtaatcttaatgatacgcgttatgcctcacgtattgtactcaatgaattttactctttttttcgatctaataacttgagtacaaaggttaaagtggttcgtggaaaatggacatcacagatgcgcaagaagtggaatggagtaggtggactatctaaaacgcgtgatacataccatcatcatgcaatcgatgcttgcattattgcatgtttcccattattaaaggcatttgataaggctataaagttaattgatgttgacggagaaactggggaaatactacaagataaaaaagcaataaaattggcacaggaagcagagatagtagaaaaaatatctgttattaaaaataaaaagttcgagaatatggttaatgagatttataattttccgctttttaaacaggtggaattagcaaatgatatcaccaatttggaaaatcctgtaaagttcagtcatcatgttgataagaaagctaatcgtgcagttgcaaatcagacaatttatggaacacgtattaaagaaaaagaagtaactaagcgtggaaaaaaggaaaaaatacaagaaagatatacgttaggtacaattaaaaatatctatgatattgatggctttatgaattttaaaaaattgtacgataaaataagtaaaaatgatgatgtgaagtttttaatgcagaaaaatgatccgaaaacatgggaaaaattgattgatatatttaattcttatcctgattcagaagaagttactcaagtggatggaaaagttaaaagagttgcagtttctccatttaaactttactatcgtgagaatggttttatcactaagtattctaaacataatgatgggcccaaggtggtaagtataaagtattatgattcaaaggtggggagtcacattgatattacacccaaagatgcgagaaataaggttattttacagagcttgaagccatggagaacagatgtctattttaattcaataactcaacaatatgagttacttgggttaaaatattcggatttaaaattcacaaatggtgtttacgggataactagagatgcatatgagaaattaaaacatggtgtaagcgaagatggtgtaacagcatggaagcctattagtaaaaatagtgaatttagatttagcttgtatcgaaatgatcgagtaagggtcattgatgaaaagggtgactcaatcgaattattatttgcttctagaacaacaagtaacgagggctatgttgaactgaaaccaatttataaagctaaatttgatagtaaagaagaagttggtttttacggacttgtttcaaacggacgactcattaagaaaatgagcaagggagggtataaactttataaagtaaatacagatattcttgggaaaccatattatgttacaagagaatcagatgagccaaagttaagtttgtag

SEQ ID NO: 324 - DNA, 4188 bp, Lactobacillus jensenii DSM 20557
atgaaagaaataaaagactacatcattggtctcgatatcgggacaaactcatgtggttacgtagtaacagataaacaaaataatattttgaagctaaaggggaagactgctatcggcgcacgcctttttaaagaagggcaagctgcagctgatagacgttcttttagaactactagaagaagattagcaagacgtcactggagattaggtttacttgaagaaatctttgatccagaaatggaaaaaatagatcctaatttttttagaagattaaaagaatcagactattctcctaaagatagtcgtaagcaatttaatgcaattgtttttaaaagtataaaagctgacaagagattttataaaaaatatccaactatttaccacttacgtaatgctttgatgcatgataatcaaaaacatgatttacgcgaaatatttatggctgttcaccatattgttaaatatcgcgggaactttttaagagaagattcagttaatgcttttaaagcagctaagttttctttgcgtggtgaagatgggattggacctgttgataaattaaatgatttgttgaaagaaatttattctgaatattcaccagaacttgcaactaataatttatctaagattgaagatattattaaagataaaaacttatataagcaagacaagcttaaacaagtagcgactttgttaattaaagaagctgattcaaaggataaagctaagcttaataaagatattgctaaacaagttgctaactcttttatgggctatatgtttagattagatacactctttagtcttactgatgttgatgtgaaggactataaattaaaatttagcgatgctaatattgatgaatctttggatgatttgactagtttattgacagatgcacaaatagaatttgtattagaactgcaaagcatttataatactatagttttaaatgagattgttccagatggaatgagtctttctgaatcgatgattaagaaatatgatgatcataaggaagacttgaaaatatttaaagaatatattgattctttaagtgatcagaaaaaagctaaaaaactgctatcagcctataatttatatgttaattatcgtaaatctgatttagtagaagctaagaatttgtttaaaaataagaaggtaggggacaaaaattttgccgatgtaataagcaacttcgaagtatttggcaaatttgtttctgataatttagatgattcagaattagctaataagattaaggctagacttgatttaggtgaatttttaccaaaacaaagaaccaatcaaaatggagtgattccatatcaattgcatcaagttgaattgacgcaaatacttgaaaaacagggaaagtattatccattcttgattacacctaatcctgtagaaagtcatagaaataatgctccttatgaaattagtgaacttgtatcattccgggtgccttattatgttggaccattaattgataatcaaagtattaaagataaacaaaataaaaataagtttgcctggatggtacgtcaaaagcaaggtcaaataacgccttggaatttggaagaaatggttgatactacagaatcagctaatcaatttatcaagagaatgacaaggaaggatacgtatttattagctgaagatgttttaccaaaatctagtttagtttatcaaaaatttatgatattagatgaattaaatagaataaaaattgacggcaaaaaattaacaagtgaactaaagcatgatatttttgaaaaattatttaagaagcaaaaaagcatcaatttagataacttaaagaattatttattagtagagggcaatattccaggtttgattgagggcctttctgatggaattaattttaacaatagtttttcaacttatattgattatcgtaatatctttggtgatgagattgataatcctaataagcaagctgacttcgaaaagatgattgaatggtcaactgtgtttgaagaccgtaagattttcaagcggaagctaaaagaaattacttggctaacatctgaacaaattaaacaagtaagtagtaaacgctattcaggatgggggagattatctaagaagttattaactcaaattacggatgaaaatggtgttaatatcttgcaaagactctggaatgaacctgaaactttaactgaagttttagctaatccggttataaaaagaaaaattgtagaagctaatagttcctttactaaagcgaaagatatgaaagatatcttggttgaagcatatacttctccacagaataaaaaggcaattcgtcaagttatgcgagtagttgatgatattattgccgctgctcatggtaaaaagcctagtcaaattgctattgaattcgctcgtgaagatcaagataatccacaaatgactaagtcacgtaaggctcaacttgatcagatatatgccaagattagcgatgagtttttagatgatgcggttaaaaatgaactaaagaatatgaaagataataagcctttggctaaggacaaggtgttcttgtactttaagcaaatgggtagggatgcctatagtggtgaaaaattatctttagataacttgcaagattatgatattgatcatatttatccacaatcatttattaaagatgattcctttgataacagagtacttgttcaaagagcttataacaacggtaaatctgataatgtgccagtactcttatttggaaataaaatagctgcaggtttgggaattactattcgtcaaatgtggaagaaatggcttgaacttggacttattagtaaacgtaaatttaataacttgattacagatccagaaaagatttctcgaaatatggcttcaggattcgtaaaccggcaattagtagaaactagtcaagttattaagttagttgctaatattttgcaggctaagttacctgatactgagattattgaagtaaaagctagctacaattctatcttgcgtaaggaatttaacttatacaagagtcgtgaagttaatgattatcaccatgctattgacgcatacttaactacgattgttggtaattacttgtatcaagtctatccaaaacttagaccatactttgtatatggacaatttaagaagtttggcaaagctgaaaatcaagaagatgatccagttaagaaaattaagaaattcaactttatttatcagttgatttggggtaaggatgatgcaatttgcattagccataccaatcaacaagtctttagtaaaaaagatattattgacaaattaactactgcatataacttcaagtatatgaatatatcacatgcagtttacacccgtaataataatatgtttaaacaaacgcttttcccaattattgaacgtactacggctaaaaccaaaagtttgattcctaagaagcttgatcgaccaactgatatttatggtggatatagtaataataatgatgcataccttgcattagtcaaagtagataaaaagagggggtcagaatatcgcgttgttggtattccgatgagagctgctgccatgcttaaagcttcaaagaattatgatgaagatttacgcaaagttattgaaccaatggtaatgtttgataagaatggtaaggctaaacgtggaattgaaggattcagagttttagttggtaagatgccatttaagcaagctgttcttgatggtaataagaagtttatgctaactgggactgttgatacaccgaatttaaagcaattggtgttgtcacagcaaaatatgaaatatattcttgattatattgaagatgttgattgtcgaaaacataaatttggtgataaggttcaaaatccagataaatgtctacttgaagtattcgatgaaattattgaaatagttgataaatattttgaattgtttgatagcagagattttagagaaaaattgcggaacagtagaaataaatttataaaattagaagcttctaagaaggctgatacaatattagcaattcttaaaggccttcaggcaaaatcaacgagggcaacaattaaagaattaaatatatcagattttggaagaattataacttcgagtatttccccagaagcacaacttatctatcaatctccaacaggcttatttgaaagacgtgttaaagtcaaagacttataa

SEQ ID NO: 325 - DNA, 4128 bp, Lactobacillus johnsonii DPC 6026
atgaccaaaattaaagacgactacatcgtaggattagatattggtactgattcatgtggatgggtagccatgaattctaacaacgatatcctcaaactacaaggtaaaacagcgattggatcgcgtttatttgaaggtggaaagtcagcagctgagcggcgtctgtttagaacaacccatcgaagaataaaaagaagaagatggcgtttgaaattattagaggaattttttgatccttatatggcagaagtagatccatatttctttgctaggttgaaagaatcaggcctttctccattagataaaagaaaaaccgtatcttcaattgtttttccaacttctgctgaagataagaaattttacgatgattatcctactatttatcatcttcggtataaattaatgacagaagatgaaaaatttgatttaagagaagtctatctagcaattcatcacattattaaatatcgtgggaatttcttatataatacatcggtaaaagattttaaagcatcaaaaattgatgtaaaaagtagcattgaaaaattgaatgagttatatgaaaatttgggtttagatttaaatgttgagtttaatatctctaatacagcagaaattgaaaaggttcttaaagataaacaaattttcaaaagagataaggttaagaagatagcagaattatttgctatcaaaactgataataaagaacaaagtaaacgtataaaagatatttctaaacaagtagccaatgccgttttaggttataaaacaaggtttgacactatagcactaaaagaaattagtaaagatgaattatcagactggaattttaagcttagcgatatcgatgcagatagtaaatttgaagcattaatgggtaatcttgatgaaaatgaacaagctattttgttaactattaaagaattgtttaatgaggttactctgaatggaattgttgaagacggaaatactttgtctgaatcaatgattaataaatataacgatcatcgtgatgatttaaaattgctaaaggaagttattgagaatcatattgatcgaaagaaagccaaggaattagcattagcttatgatttatatgtcaataatcggcatggacaattattacaagcaaagaaaaaactgggaaagatcaagcctagatcaaaagaagatttttataaagtagttaataaaaatttggatgattctcgagcatctaaagaaataaaaaagaaaatagaactagattcctttatgccaaaacaaaggactaatgctaacggtgtaattccttatcaattacagcaattagaactggataaaattattgaaaatcagagtaagtattatccattcttaaaagagattaatcctgtttcgtcacatttgaaagaagcaccgtataagctagatgagttaatcaggtttagagttccatattatgttggaccattgatttcgccaaatgagtctaccaaagatattcaaacaaagaaaaatcaaaattttgcatggatgattcgaaaagaagagggtcgaataacaccatggaattttgatcaaaaagttgatcgtattgaatccgctaataagtttattaagcggatgacaactaaagatacttacttatttggcgaagatgtcttgcctgctaatagtctcctttaccaaaaatttacggtgttaaatgagcttaataatatcagaattaatggtaagcgaatatcagttgatttgaaacaagaaatatatgagaacttgtttaagaaacataccactgtaacggtaaagaaattagaaaactatctaaaagaaaatcataatttggttaaggttgaaattaaaggattagccgatgagaagaagttcaattctgggttaactacatataatagatttaaaaatttgaatatttttgacaatcaaattgatgacttaaaatatcgaaatgattttgaaaagattatcgaatggtcaacaatttttgaagataaatccatctataaagaaaagctgagatctattgactggctgaatgagaagcagattaatgctctaagtaatattaggttacagggatggggtagactatctaaaaaattattagctcaattgcatgatcataatggtcaaactattattgagcaactttgggatagtcaaaataattttatgcagatagtaactcaagctgactttaaagatgcaattgcaaaagctaatcaaaatttattagttgctactagtgtagaagatattttaaataatgcttatacttcacctgcaaacaaaaaagcaattcgtcaagtaattaaagtggttgatgacattgtcaaagcagcttctggaaaagttcctaaacagattgcaatagaatttactagagatgccgatgagaatcctaagagaagtcaaactagaggaagtaagctgcaaaaagtttataaagatttgtcaactgaattagcatctaagacaattgcagaagagctaaatgaagctattaaagataaaaaacttgtgcaagataaatattatctatattttatgcaacttggtagggatgcctatactggagaaccaattaatattgacgagattcaaaaatatgatattgaccatattttgccacaaagtttcattaaagatgatgctttagataatagagttttggtttctagagcagtaaataatggtaaatcggataatgtaccagtaaaattgttcggtaatgaaatggctgctaatttaggcatgactattagaaaaatgtgggaagaatggaagaatattggtttaattagtaagaccaaatataacaacttattgacagatccagatcatattaataaatataagtctgcaggttttattcgacgtcaattagttgaaacaagtcaaattattaaactagtttcaactattttacagtctcgctatcctaatactgagataataaccgtgaaagccaaatataatcactatttacgagaaaagttcgatctatacaagagtagagaggtaaacgactatcatcatgcaatagatgcgtatctttcagcgatttgtggcaatcttttatatcaaaactatcctaatttacgtccattctttgtttatggtcaatataagaaatttagctctgaccctgataaagaaaaggcaatttttaataagactagaaaattctcttttatctcacaacttttgaaaaataaatcagaaaatagtaaagaaatagctaaaaaattgaagagagcatatcaatttaaatatatgcttgtctctcgagaaacagaaactagagatcaagaaatgtttaagatgactgtctatccacgattcagtcatgacactgttaaagcccctcgtaatttgattcctaagaagatggggatgtcgcctgatatatatggtggatatacaaataattctgatgcttatatggtaattgtgagaatagacaagaaaaaaggaacagaatataagattttaggaatacctaccagagaattagttaatttaaaaaaggcagagaaggaagatcactacaagtcttatttaaaagaaatacttacaccaagaattttgtataacaagaatggaaaaagagataaaaagattacctcatttgaaatagttaagtcaaaaatcccatataagcaagtaattcaagatggagataagaaattcatgcttggtagctcgacatatgtatataatgctaaacaactaacattatcaactgagtcaatgaaagctattacgaataattttgataaagatagtgatgaaaatgacgcattgatcaaggcttatgatgaaatactggataaagttgataaatatttgcctttatttgatatcaataaatttagagaaaaactgcattcaggaagggaaaaattcattaaattatctctagaggataaaaaagataccatcttaaaagttttggagggattgcatgataatgcagtaatgacaaaaatcccaactattgggttgtcaacaccattaggatttatgcagtttcctaatggcgtaatactctcagaaaatgcaaagttaatttatcaatcaccaacaggtttatttaaaaagagcgttaagatttcagatttgtaa

SEQ ID NO: 326 - DNA, 4026 bp, Lactobacillus lindneri DSM 20690
atgacacagaaagtaataccgtataacatagggttagatattggaactaattcagtaggttgggcagttactgacaatgaaaataaattattacatattaaaggacacaatggaattggtgttcgattatttaaagaaggacaatcagcggctgaaagatgtggttttagaactacaagaagacgattatcccggagaaagtggcggttgcgtttattaaacgaaatttttgctgataaaattgcaaaagttgatcctagcttttttgcaagattgaaacaatcaaatgtttcaccaaaagatccgaacaaaactatgtttggaaatattttatttgataatggaaatttaaatgataagtcttttcatgatgagtataagactatttatcacttgcgacagtcaattattgatcatccagaaaagaagtttgatattagattaatttatttagcaatgcatcatattattaaatatcgtggtcattttttgaatcaagcaaatgttcaagattttaaaggtggaaaaattgatttagaagaatcttttaaagatttaaatagtatttttgaaaatcaaggtcgtgacttacgattggttactgaagatgctaataaatatgtaaaagaacttagcgacaattcaaaaactagaaatgaccggcagaaagaattatcaaaagttttgtacattccaattgataaaaattctgataaaaacaataaaaaggttaccactgaaataataaaagctattttaggtatgaaagcaaaatttgatgttatttttgggattgatgctgaaaatgccaaagaatggagcttaacttttaatagtgatgattttgacgataaaattgaaggattatcagctcaaatgaccgatgaagctggggaaatccttttgattttaaaagaactttattttgctttaaacttatctgatattttaaataactcggttactgataaaaatgctaaaactttatctgaagcgatgattaatcgttatgatgatcataaggaacaattaaccatgttgaaacaggttattgataactctgacaaaaagcatgctaaagcattaaaagctgcctattcagcttatattgatggtgaaaataataaaaaaatttcttttgaagatttaagaaaacgaattcaaaagaatttagataattcagaaacctcaaagaaaataaatgatttattggaacatgattattttttaccaaagcaacgttctaaagaaaacggtgcaattccacatcaattacaacaacaagagttggataaaattattgaaagtcaaaagcattattatccctttctggctgaattaaatcctaatgaaaaacgtagtcgacaagctaaatataaacttgatgaattagttgctttccgagttccttattatgtgggtccgatggtgaaagccactgaaaataatcagagtaataacggtaagtttgcctggatgattaagaatgataatatttcagataaacttaaaaaagaagaaattactccttggaactttgataaaaaggttgaccgaactgaaacggcgactaagttcattactagaatgactacaactgatacatatttaattggtgagccagttttacccaagaatagtttgttataccaaaagtttgtagttttaaatgaattgaataatttaaaaattaataaacaaccaattacacccgaacaaaagcaatatgtttatgagcatgttatgaaacaaactaaacgtgtctcattgaaaaaaattgcggatgctctagtgattaaaggtgattatccttatgcaccagaaataacgggaacaacagaccaaaaaaatatgaataatggtctatcaacatacattgatttagctaaaatatttggcgatgagttagatgatattgatagaaaagaagattttgaaaaaataattgaatggtcgactatttttgaagatcagcatatctttgctttaaaacttaaagagattaaatggcttaccgaagaccaacgtaaacaagtagttaaacttcgttaccaaggttggggtaaactatctaaaaaattacttgccgatttagttgatgataatggtcagcgtattattgaccttttgtgggattcaaagcaagactttatgcaaattgtaaatcaaaattcatttaagcaagccatagcagaacacaatggcgctcatttagaagaaaaagatttaaaagatattattaataatttgtatacatctccacaaaataaaaaagctatccgacaagtcattttagttgttgatgacatcattagggctgttgggtatgaaccagttaatattatgatggaattcgctcgtgaagattctaaagaccatcgcttaaccaattctcgaagtcgtcaattagaaaaggtttataaagatattactaatagttggtttgatgacgataatgttaaagatgaattaaaagataagattaaagataaagctaaatttactgatcgtttatatctctattttacccaagggggaaaagatttatatactggtgaacctttagatattgataatctatctaattatcaaattgatcatattttgccacaatcatttattttagataattctttagacaatcgggttcttacttctaagataaataatcaaattaaaaaggataacttgccgggtgaattttttggttctaaaatgcataatttttggaaacatttgaaagaattacatttaattagtaataaaaaatactataatttaacgcttactcctaactcaattagtaaatttaataatcaaggacgttttattaatcgtcagttagtcgaaacaagacaagtgattaaattagctgctgaaatactccataaccgttattctgaagaaaatggaactaacattgtgacagttaaagctaacttaactcaccatatgcgagaaaaatttaatttttataagaaccgaaatgttaatgattatcatcatgcgtttgatgcatatttagctgcctttgtagggaattggctcttacaacaatatcctaagttaaaaccatattttgtgtatggtgattttgctaaaactgaaattgataatttgaaatcatttaatctgatttataagtttgaacaagctcatcaattaaatgaagaagatggaaaaattgctaaagatacggatgctttattaggttatatgaaaaatgtctatcactttaagaaaatgttggttactaaagaattggaaaccaatcatggcaatttgtttaaacaaactttatatccctcccatggtaagatgaaaaatttaattaatccaaaagaaaataggtcaagtgatatttatggtggatattcttcagaaacaggagcttatgtttctttaattaaagtatttaaaaagaataaaattgaaaacaagattatcaaaattcccttactgtatattgataaattgaataggcaggcaaacgctaagcaatttataagaaattttataattaaagatgattcaaataaatttgatatcttatcagaaaaaatatttcttaatcaattagtaattgatggtgatgagttgtttacaatttctgggagtggagatagacaaaatgctcagcaattaattttatctgataaatcactgaaaattttatctaaaaacattaatgtaattagtaagaatgatttaattattatttttaatgaaattattgatgatatttgtaaatatatgaaaatgtatgaagttgagaattcagatgaaacaaaagctaagtttgaagaaattaatgataaagatcgtatgttaaaaataataaatgatttattactaggtttacatgcaaatgcttctaggtctaatctatcttctattggtctatctccaagttttggtagattttttagcggtaatgctggaattaaattaagtgaaaatgcaaaatttatttatcaatcaccaacaggtttattttcaagaaaagttaaaatttctgatttgtaa

SEQ ID NO: 327 - DNA, 3525 bp, Lactobacillus mali ATCC 27304
atgggaaagtatagtatagggttggatattgggatttcttctgttgggtggtcgattattgatattgagaagaaaaaaattgttgatttaggcagtcgtatttttccatcaggaaatgcagcggctaatcaagatcgtcgcggatataggggaacaaggcgtctgattaggagaaggaaaaatagattagcggacgtaataaattttttaggagaagaaaattttatagacacaaaagtagtagatcaaaatgggaatatacactacaaacttttagtaaatagtactgaaagcccttataaattgcgtgttaagggtttgtccaaaatgttaacaaagcaggaacttgttattgcactttaccatatcgtaaaacatcgaggtatttcttatgatttaggtgatttggaagatgatggaacaagtggtgtaactgattacaagacttcaattaatattaatcgtcaattgttaattaaaaagacagttggtcaaatacaattggaaaggttaaaggagtttggtaaagttcgtggacatgtaaaaaaagatgaaaatataactttgctcaatgtttttccttcatcggcatatgttaaggaagctacacaaattttgacaaagcaaagggaattttatccagaaattactgatgattttattacaaagttcataccattcattagtcgtaaacgagactattttgttggacctggaaatgagaaatcgcgcacagactatggaatttataaaaaagatggtcgaacattagataatctttttgatgaactcataggaatagataaaattagcggagaaaaaagagcatcagcatcaagtgtaactgcacagatatataatatgcttaatgatttgaacaatttaacagtaaccaatactgaagatggaaagctaacaactcaaacaaaaagggaaatcattgaagcagataaaactacaaatggtttgtttggaataacgcaaatttgtaaaataataggttgtaaaaaagatgatatcaaagggttccgaattgataaggttgaaaagccaattatgcatacactctctggttatcgaagatttcgtaaagaacttgctaagattaatatagaagcaaatgatctggacattaatttagttaacaaaatcgctgatattctgacacttaatactgagaaagctgaaattcgtaaacaattgaataaaagtaatatagatgtctccaatgagataaaggaacttattatcaataaaaataaggattttttggtagatggtcgagcaacatggcatagcttttcttataaaacacttaatttacttataccggaattgatgaatacttctgaagaacaaatcactattttgacacgtttgggtctggtgaagtctaatagtgaaaaatataaagggctcaaaaacattcctgcacgaagaattacagaaggtatatataatcccgttgttgctaaagccacacgtgaggctgttaatgtttttaatgcaattgctaagaaaatagggcgtgataatattagcgacgttgttattgaattaccacgtgaagataatgaggcagatataaaaaaaggtattgttaaaagacagaagcaaaatgagttagaaaaagaagctgctgatgcattagttaaacaacagatgacgatatcagacagtgcattagttgcacattatcgtaaggtcaggggcctatctcagaaggtgcggtactggtatcaacaaggtacttgttgcccttattgtgggaaaaatattgaggcggttcaactaatcaataataatgatagttttgaggttgaccatattataccaatttctgtaagttttgatgattctcaaaataataaagtattggtacacagccaatgtaatcaggcaaaaggaaagcaaacaccacttggctggctaaataatggcgggggttttggacaaaataaaactgaatatgttgctaaggtgaaaacaaataagaattattcaaaaaataagatggataatttattgaatgatatggatcttagtgacattgttacacagcgtggttttatccagcgaaatcttaacgatacgcgatatgcctcacgtattgtacttgatgagttttattctttttttaaatcaaataatttatcaacaaaggttaaaatagttcgtgggaaatggacatcacagatgcgtaagaagtggaacggagtaggtgggctgaagaaaactcgtgatacatatcatcatcacgcgattgatgctagtattatcgccagtttcccattattgaaagtatttgataaggctataaaattaattgacattgatagagaaacaggagaaattctgcaagataaagaagcaattaaaatgtcacaggaagctaagttactagagaaaataccggtcattcaaaatgagaaatttgaagagctcattaatgaactttatgattttccactctttaaacaggtagaattagcaaatgatattactaatccagaaaaccctgtaaaattcagtcatcatgttgacaaaaaagctaatcgttcagttgcaaatcagacaatttatggtacaagaattaaagaaaaggaaataaataaacgcggaaaagtagaaaaagtgcaagaaagatatattttaggcacaattaagaatatatatgatattgatagctttacaagttttaaaaaaatatacgataaaatgagtaaaacaggtgatgtcaagtttttaatgcagaaaaaagatccgaaaacatggggaaaattagttgaaatacttaattcttatcctgattcggaagaaattacacaagtagacggaaaagtcaaaagagttaaggtttcacctttcgagctttatcgccgagaaaatgattttatcacaaaatatgccaagcataatgatgggcctaaaatagtgagtataaagtactatgattcgaagattggaagccatattgatattacacctataaatgcaaaaaataaggttgttttacaaagcttaaaaccatggagaacagatgtctattttaattcagaaactcggcaatatgaattacttggtttaaaatattcagatctaaaattcacaaacggtgtttatgggattactagcgaagcatatgagaagttaaaacatggtataagcgaagatggtacaaaaacatggaaaccaattggtaaaaatagcggatttagattcagtttgtatcgaaacaatcgagtaaagattgttgatgaaaaaggtgaatcacttgaattattgtttgcctctaggacgacaagtaacgaaggatatgttgaactgaaaccaatttataagtctaaatttgatagtaaagaagatgttggtttttatggtcaaatgactccaagcggtcagtttgtcaagaaaatggccagagttggatataaactctacaaagtaaatacagatgttttaggaaatccatattacattacaaaagagtcagatgatccagagttaagtttatataaaaagtaa

SEQ ID NO: 328 - DNA, 4074 bp, Lactobacillus mindensis DSM 14500
atgaacgatcgaaataaaaaatacaatattggattggacatcggtacaggttccgtcggatgggccgttactgataataattacaatttattacacgcaaaaaagaagaacctttggggaatacggctcttcgatggtgcagagacagctgctagtcgtcgaacttttcgatctactagacgtcgttatcgcagaagacgtaatcggatcaattggttgaatgaaatctttgcagatgaattggctaaaaaagatcaatcatttttagttcggatgaattcctcatgggtctccaaaaaggataagataagacaacgtgatcaatataatttatttatggattccgattatacagatgtggaatatcatcgtgaatttccaactatttttcatctaagaaaacgattaattgaagataaatctcaagccgacatcagattggtttatttggccttacataatatcatcaaatatcgtggtaatttcacttacgagcatcaaaatttcgacgtttcacacatggattccggtctagctttactactaaatcaattgaatcagcaattacaagcatttgaagtcgcatttcctgacgaaaccaacttcgaatcaatgagtacgattcttttagaaaaaaagactcctacccaaaaaatcgatgagatagtcgaccagattcaacctgaaaaagacctacttcagataactaaaaatattatgaaaatgttgcttggtaataaagctgatttggtcaaaatattctcactcgacagtgacgataaaatcactgttgaattctcatccaactccatcgagcaagacctatcaaacttagaagaaaccttgtcagatgaacaatttaacataataacgctcgcaaactctatttatagttcaattgtccttaatgacattttgtccggtgaaacttatcttagtttcgctaaagctagacaatattctgatcataaaaaagatttagccaaattaaagactatgtggcgtgaatcaccagatagaaaagccgttggtaaagctaaaaaagcttacgatgactatctacattctggaaagtatggaatcgaagatttttacaaagatatgagtaaatttttagagactgccactcccgttgaacttgccaaagaggcaaatgaaaaaattctcaacaagagctatctattaaagcaacgcaacaatgaaaacggcgttataccattccaactcaataaaaacgaaatgattgagatcatcaataaccaagctaaatactacccatttttggccgagaataaggataaattactttctatcctcagttttagaatcccttactatgtcggacctctgcaatcgaaaaaagacaatccgttcgcctggatggagaagaaatctcaaggaaaaattcgtccttggaacttcgatgaaattgttgaccgtgaagcatcatcaaataactttattaggcgaatgactagtaccgatacttacttaattggtgaaccagttttacctctaaagagtcctatttaccaaaaatatgaagttcttaatgaattaagcaatgttcgtatcaatgccgatgaagtggataatccacttggtgacaagttatcagtcgacttaaaacaagccatctataacgaattattcctcaaacatcgtagtgtttcaaaagcacttctaactaagtggttgatcaatcaaagttatttccaaaatccccaaataagtggtctggcagattctaaaaaattcaattcaggattaactacttatcacgatttcaagaaaatttttggtgaagatttcgtcaatgatccaactaaccaatcacaactagaacaattagcagaatggctaactatttttgaagataaaaagattctaaaaataaaattggacgattctcaattcaattgcacacctgaacaaattaaaaaaattgctggaatgcgttatcaaggttggggacgtctttcaaagaaactactctgtgatattaagacaactactgtcacaagtaaaaaccatcaacaagctagttactcgattcttgatttaatgtggaataccaatcgcaactttatcagtgtcttaaaaaatgatacttataaattcgaagacaagattcaaacttttaatctcgataaaaacgaagccgctactcctcaagcaatgattgacgagttacagacatcccctgctctcaaacgtggtatccgccaatctgtaaccatcattcaagaactagttaaattcatgggacatgctccagaacatatcttcctagagttcactcgtgaagatgacgttagttctttaaccaaatccagagacagccgtctcaataaactttatgcacgcatcgccaagaatactaaaaaaacagacgatgagctgaagaagtccttgttgccttctagtgatattaaagctaccctcaaggctaacaagaataacctatccaacgaccgtttgatgttgtactacctacagatgggaaagagtttgtattccaatcaaccattggatattaacaggttatctgaatatcaaatcgatcatattttgccacaatcatatatcaaggataattctctagaaaatcgtgctttagtattagcttctgaaaatcaacacaagtctagtgatttattattaaagccagaaattattaatcaaaatattgctcgttggcgttacatgaaagatgctggcttaatgggtcctaagaaatttaagaatctcacacgaattcaaattactgacagtgatcaaaacaatttcatcaatcgtcagttagttcaaacatcacagatcatcaagcatgtctctaatattcttgattcaatgtatggcgaccaaggcactcaatgtgttgaaaccagagcacatctctctacagagttcagaaaagccttcagcaacgaagatgataactatcacttccaacacccagagttcgttaaaaatcgtaatatcaacgattatcaccatgctcaggatgcctacctagcctgcttacttggtttataccaaatgaagaaatatccaaccgataacatgattctgttgaagaaagaatataagagattcttcagcaatactaagaagatctatgacaagaaacatcattttcctgattacgttaaaaatggttggattatcggttcaatgttcaacggagagaagtatgttgacgaggaaactggtcaaattatttgggatcaacaaacaaaagatatggtcagctgtattttccaatacaaacaatataacgtcactaaacgtaccgaagctgctaatggtgaattttacaatcaaactgtctacaagaaggaccctaatgaaaaacgtaagctaatttcgcttaaacaaggtctggatactaaattatatggtggatattctggtgacaatcctgcctacattgttttagtaaaaatcgatgataagaaaaataaactagttaaaatgcctattcgtttggctgaacaagttgataataagacaattgatctacaaacttggctagaagaaaatgttccacacaaaaaaggcatccaagtcctcaaaactaagatacctttgggtcaagtcatttatagtaagaagaatggttatctagcactcaaatctgatactgaaattgttaatgctcaacaactagttctaccttatggttatgttgcgcttctgactttgttacagaaaatgcccgaaaacaaatatgatgaagtactagcttgttatgacgatggcattttggataatatcttcgttgctatcattgataaaatgaaacacttctatccttactactctggcgagcttaaaacattatcggataatatcgataacttcaaagaatctccggatgttaacaagattaagacattacaacaattgttgttactgttacacgcaagttcaacaactgcatctattgaatttaacaatgttaagaaaaattcattaggaagaaaaccaaatagtataaatattcaaaatactgatttactaagcttttccgccactggtttatatgaatcaagaattcacatagactaa

SEQ ID NO: 329 - DNA, 4149 bp, Lactobacillus mucosae DSM 13345
ttggatattggtacaaattcaatcggttggaccgcaattgatgatcatttttcattgttgcgcgttaaaggtaaaaatgcaatcggcgtccggacttttaaagagggggaaacggcagcagatcggcgcggctttcgaacggcccggcgccgcttaagtcgacgtcgctggcgccttcagtttttggatgaattttttgcgccatatttagcagaagtagatcctaattttttggcaagactcaagcaatctgatatctcggcaaaagatcctgctaaaaatcaagaatatatggggaaattgctgtttccggatcaggaagctgcatcagatggaaatggatatcctacgctgattcaaatgcgcaaagcaatgccagctgaaaaggcagcagattttccagtctttaacatttaccagctgcggtatgcactgatgaatgaaaagcgtaagtttgatctacgtgaaatatatcttgctgttcaccatatcgttaagtaccgcgggaattttttaaataatacaagcgttgacaagtttaaagccgatcaaattgatttcaataaatcgtttgagacgctaaatgacttattccgtcaagtacagccgatcgccccatttcaaattgacttgaccaaggtagacgaattgggaaagcttttattggataccaagcaaaagaagcttgatcgtcaaaaggctgttgccaaactattgccattgattgaagatgggactgataaggagatcgttaaagctcatcagcaaacggctcgtgaaatcagtaaattaatcctgggatacaaggcaaaggtcggtttgatcctgcaaaacaatcttgaccagacgctggatatgagtacggaaaacagtgatgatcagttgatgcagattgccgaagaactggatgactaccagatggagctgattaatcaactgtcattgctgtattctcagatcatgctcaatgaaatcgtacccaatggcgaaaccgtttcggcatcaatgctgaaccgttactacaagcatcgctgtcagttaaaagaattaaaagattatggtgctgcccaagataaaaaaactcgtgagcagctcgatcatctttatgctgaatatattggccagattcctaaagacagcaaatttgactttaccaaagatttgaaaaaattgatggacaagtctgacctgggacaaaagattaaagacgagattgaggctggcgactacctgccgaaacagcggacatctgcaaacggtgtaattccgcaccaaatgcatcaacaagagcttgatcaaataattgaaaatcaaaaagaatattatccttggctggcagaaccaaatccagttgaaaagaacattaagaatgccaaatataagctggatcagttagtcagcttccgtgttccatattatgtcggaccaatgatcactttggctgatcaacaaaagacgtctaaggcctcttttgcatgggcagtcagaaaaaaagctggcaagattacgccatggaatttttacgatatgattgatcgtgagaaatcggccaataattttatcaaacggatgacgaataaggacacttatttgttaagcgaggacgttttgccggcatcaagcttactgtaccaaaaatttacggttttaaatgagctgaataatattcgcgtgaatggtcgcaaactacagccagcactaaagcaagctatctatacggacctgtttcagaagcgtaagacggttaatcttaagactttgacgaatttcttggcgattcacgaaccaacgctgactaagccaaaaatcgaaggactgtcgaatggtcgcagctttaattcaagtcttggtacctatattgatatgtctaagatacttggagacagtcttgatgatttaaactatcgtgatgatattgaaaagattatcgaatggtcaaccgtatttgaggatagtgagatttacggcgtcaaactgcaggaaatccagtggctgaccaacgaacaaagagaaaaattggttcggaaacgttatcagggatgggggagactctccaagaaactgttaacggggatcactgatgaaaatggtcagcgcattattgatctaatgtgggataccagcaaaaactttatgcagatcgtgcatcaaccagtctttgaagaacaaattgctgaacttaatcagcagctgttgcaagacgctgacaaggcaccattggaagttgttgacgatattttggctgacgcgtatacatcgccccaaaataaaaaggcaattcgccaggttgtcaaagtcgttgctgatgttgtcaaggctgttggcaatgccccagcatcgatttcaattgagtttgctcgtaatgaggatcgcaacaaggaattgaaaaacagtcgacggcacagcattgaaaagctttatcatgaaacggccgaaaaactggtcaagcaaaccaatctgcttgaagaattgggaaacgtcaaggatttgaatgatcgctattatctttactttacccaggctggtcgtgatatgtatgatggcacgccaatcaatatcgatgaaatcagcacgcattacgagattgatcacattttgccacaatcattcttgaaggataattctttggataatcgggtcttggttaagaaatctgaaaacgcggctaagtcggatcgagtaccggcaaagctttatggagctaaaatgcgggccttttggaagcaacttaaagaaagccagctgatcagcaatcgcaagtatcttaatctgacgaccgatccagaacaggttgacaagtatcagatgcagggatttgttcatcggcagttggtagagacgcgccaaatcatcaagctggcagccaatatttttggttcgctttatccagacagcgccgtgattgaaacgcgggccgagcttaccaagcaattgcgtgaaaagttcagcctttataaagtacgtgacgtaaatgactatcaccacgctgttgatgcttacttgacggcgtttgctggccactatctgtatcaacgctatccaaagctgcggccgatgtttgtctacggtgactatgccaaaatttatgctgatgatttgaaacggttgcgctcggttaatctttttcatgacttggaaaaagatcaatacaatagtggaaccgcggtaaatccagaaactaaggaaaaaatcgtggatgtcgactggctgagcgattatgtatccaagattcagcatttcaaatatatgctgatttctaaagccgtttatactcagcacgggcaactttatggggcaacgattcttccagttgcgcaggttgataaaatctcagcaccaattggcattaaggacgataaaccggtcgatatctacggtgcttataccaatgaggttgctgcttatatggcaatcgttcgcgttaacggcaaaaagcctaagtataaggttgttagcgtaccggtcagaatgctgcagcgactgaagatggctgaacaaaaaggtcatgatcagtatatgcagaccctgcacgatgttttattgcgaaacttcacttcgcttaaaaagaaccgtaaaaccggattaaaagaagccgtggtaaaagactttgacgtgctggttccttgtgttcgctataatcagttagtcattgacggggataccaaatttacactggggagtgctacttatcagcataatgccaagcagctggtattatgcaatcattcattagaaacgttagctaataattttgaatacgtcagaaaacatcctgatgaagctgatgaacggatgataatgctttatgatgatattcttgaccaggtcaaccactactttacgctgtatgataaaaataaattccgtgaaaaattaaatgcaggccgagataaatatctgaagctgccaaccttttcacagtttgaaaacaacaagaagacggcaattggcaaatccgaggctataatcaacatattgagaggactgcatgccaatgcggctataacgaacttaaagtgtttgggcgtgtcaaccccatttgggcaattacagtcgccatctggtattgaattatcagaaaatgcaaaattagtatatcaatcaccaacgggcttatttagcagagaagttttgttgaaagatctgtag

SEQ ID NO: 330 - DNA, 4131 bp, Lactobacillus namurensis DSM 19117
atggataagaagtatggcattgggttagacatcggaacaagctcgattggttggaccgtagttgataaatacggccatatcatccgggttaagggccaaactgggattggtgtgcgtttattccgtgaaggacaaacggcggccgagcggcggacttttcggacaacccgtcggcggctaagtcggcgacggtggcggttgagattgttacgggaaatttttgatgaaccgatttctgctattgatgagaatttttttgctcggcagaaggcttctagcttagctcctggagatgctcgttatcagcaagcgtttcagctttttaacgaccgaacagaccaggcattttattgcaagtatccgacaatctatcatttgcgtcaggcgttaatgacggagtcacgacagtttgatatacgagagatttacctagctcttcatcagattattaaatatcggggccatttcctgttggggggagcggccaaggactttcaatcagataaactggacttagaggcctattttacgacgattaatgctcagttggcggggatttactcggatggctctgttcaattgcctaccttggattggaatcaggcttgccaagaactgacggacaccagtcgaacgcaaagtgaccgaaaaaattggctagttaaagagctgaaaagttacggagattctcagttaaagccaatttacacgcaaattgctaatgctattttaggattcaaaacggatcttgctaaaattatgggaattaatgatccggagaaagccttatcatttaatctggatgccttggatgaccatcgagacgatgtggcggaacttttaacggatgagcaaattccactggtgaacctgttggcgaaattacatacagcattggaactagccgctattttaccggatggtcaaactttgtcaggcaaaatggtggaaatctatgaaacgcaccgaaaacaattgaagacgtacaaggcgtttattcggcaactaccagatcgacagcagcggttagcgttaaagcaggcttatgaccattatattgatcaagggttgaatcgagaggccttttacagtgaagttaaggccattcttgagaaacagaaaccgttgacagcgacaggacaagcaatgaaaaaagctatggatcagaatgcctttctgttgaaacagcgaaccaagaccaatattgcgattccttatcaggttcagcaacaggaaatggaccagattattgcgaatcagtctaagtattacccttggctggcaacgcctaatccggttaaaagccggcgcgtgattgccccctataaacttgatgaactggtttgttttagagtgaattattatgtggggcctttggttcagtccaaacccggtgaagcgaccaaagaagctaagtttgcgtggatgacgcgtaaggaccctcaatcaacagtagcaattaccccctggaatttcgatcaacaggtggatcgtcaggcttccgctaatgcgtttattcaacggatgaaaacgacggatacttacctgctgggagaagatgtgattccaaaaaatagcttgttgtatcagaagtatgaagtacttaatgagttgaacaatgttcgggttaatggagattggttggatcctcaacgaaagcagtatctgttcaaaaagttattcatggatcaacctcagtcggttgtcaccgtcaaggcactacagaagactttggtggtaattggggcatgtcctactttgccaactgtggaaggattggctaatcctaagcgcttcttgagccagttaaccacgtatcatgacttttgcaaactgttaccggatgacatccagcgtgcagatcgacaagctgatattgaaaagattatcaactggtcgacaattttcgaagatacagctatctttaaggaaaagttacgggacattaaatggttgtcagctgaccaaattcgtcggttaagtagtcgaccacggtatcgcggttgggggcggttctcagctaaattgttatgtggcttgcatgatcgccaggggaatacggtaatggacgaactgtggcagacgagtcgtaattttatgcaaattattcgccaatccgattttcagacggcaattgctgcggtgaaccagcaagatttgggacggcaagacctgcaacgggtgattgacgacctctacacgtcgccacaaaataaaaaggccattcgccaggtgctggcagtggtgacggatattcaaaaagccatgcacgggaaggcgcctagctggttatttgtagaagtggctaaaggtgcacaaaagaacccacaacgaacgcaatcgcggcaatctaagttggcggaggcttatcgagaaagtgcgcgtgaactcgttgatgaggccgtgaaagaacaattgttaactctgccagatgatcggcagacgttttctgatcgactagttttatatttccagcaaaacggtcgtgatatttacacgggtgagcctttggactttgaacgcctgagtaactatcacattgaccatattattccccaggcggtcgtcaaggacgactcactggataaccgagtactaacgtcgaatcaagctaatttggaaaaaggagcgcatgtgccgaccatatttcgggataagcaagaaccggtctggcaggagctgtaccgggtggggttaatatcacaccgcaagttgcgcaacctcttaactactcccgatgacttggacgaccgggggcgggcaaccgggtttattgcccggcaactcgttgagacccggcaggttatcaagttagttatggaagttctgagtcagtactacgatacaaccgaaaccgagctaatttcaattaaggcggggttatcgcaccaatttcgccaggaactgaatctccctaagttacgggcactaaacgattaccaccatgctcaggatgcctacttagcagcgagaattgggacgtatttgctacaacgctacccgaacttgaaacgctttttcgtctatggggactttaaaaagacgcactttgacttgcaacgacgctttaactttattggtggcatgatttccagggaaaagcagccctataatcttattaaaaatcccgtcacccaccaggttatttgggatgaagaaatggagattggtgattgccagaagaagaatccagagcaaccgaaacatgacgctactgtgaagatgatgaacttaactaaaattatgaatttgaaacatattttggtgacccacgaagtgtacgagaatcatggtgcattgtttaatcaaaccatttatcccgccagccaagcacataaaaagaagcttattccgcagaagaccgagaaacccattgaactttatggcggtcatagtagtgaacaagcaggatacatggcgattattcggctacttgggaaacgcccaggttataaagttatgcgggttcctgttcgttatgtcagtcaattacagcatcaggatgtagcagagcagaaaaagttactctataaaattttcgtttcggaattaactagtcgaaacaaggttaagccgtttgaggtcgttgtaccacacgtttgtttaaatcaaccagttgaggatatgatcaaggggcagtggcaccgctttgctttaagaaccaatgggtattatcagaatcaacagcagttaattctgtccttggttgctcagcggactttggcgggatataaaccaaaggatgatgagttgatggcggtttatcatgaaatctgtaaacaggtcaaatactacttcccactctataaaatgaataaatttcagtcacggctatttgcggccgaggagctcttgcaaaagcgttctacagtgaatagctttagtataacaatagggaaaaatgggaaagagaataaaacactaaacttaggtaaacgtgagctcctgttgaggctgttaggtgggttgcacgccaatgcaacccgagtcgacttgaaagatattggttgtacaggtcaatttgggcaacttcaagtgaagaatggaattaagttaactgaacaggcagtccttatccatgagtcaccaacgggactatttcatcgacgggttcgtttgaacgacctttag

SEQ ID NO: 331 - DNA, 1167 bp, Lactobacillus nantensis DSM 16982
ttttacttcaaaattcgattatcagaggttgtaattatggcagatagaatcagtttaggtttagatattggtgttgcgtcggttggttttagtgtattgaatattgatcaaggcaaggttgttgaactaggtgctagattgtttaatgccaaggtggctgaaggtaatcaggatcgtcgttctatgcgtggttctagaaggttattgaaccgaaagaaacaacgccgtcaagatacggctaaattgtttgaagaatttggtttgattagtaattatgataaagataacttttcagaattttttgataacaatgagaatccctatgaattacgggttaaagggttgaccgagaagctaactaaaaatgaattggctgaaagtttatatcaaattgttaaacgtcgtgggattagttatgacttgaaagatgctgattttgaggatggcgggactgactactctagtagtttaagtttgaataataaagctttggaagataaaacaccagccgaaattcaattacaacggttaaatgagtttggagctgtgcgtggaaaagttgttgttggggatgatttagataatcagaaagtattgttgaatgttttcccaactaaggaatataaaaaagaagctcaaagaattattgctacgcaaagggaattttatccagatattttaacggatgaatttgaaaagcaatattgttcgattctaacgcgtaaacgtgattactttgttggaccgggtaatgaaaagtctcggactgattatggtatttataagacagaaggtcggacactggataatttgtttgaagagttaattggtcatgataaggtttatccagatgaattacgagcttctgcagcttcttacacagcacaattattcaatgtcttgaatgacttaaacaacttgagaattttgagttacgaagatgagaagttaactcaggccgacaaagaaacgattattaacgaattaaagagtaatgtgacaacggttaacatgatgaatttaattaaaaaggtcagcggttgtgaaaaagatgatatcaaaggatatcgaaccaacgataaagataagccagagattagttcaatggcaatttatcgaaagactcataaggaattcttgaaggctgacgttgatattactcagtga

SEQ ID NO: 332 - DNA, 3399 bp, Lactobacillus nodensis DSM 19682A
agaaatttggaaaacaaaattagcttaggattagatattggagttgcttctgttggttttagtgtaattgatgcacaagaaggtaaagtactggagttaggggccagactattcaatagttcagtttccgcggagaatcaaactcgtcgagatatgcgagggtccagaagactaagtaatcgcaagaaacaacgtcgtaaagatgtagctcaactatttaagacttttggattaataaattattttgataaagaaaattattttgataactttcaaaataatttaaattcttatgaattgagagttaaaggattatcagagaaattatcaaaagaagaactggtgaatagtttgtatcatattgtcaaaaggcgtggtatcagttatgacttggcagatgctgacactgatttcgatggttctgattactcatctagtttgaatcagaatcaattggaattacagacgaagactccagctgaaatacaacttactcgcttgaatgtacatggagctgtacgtggaaaagttacgatcaatggcgaggatgaggacactatgcaagtattgttgaatgtgttccccaccaaatcatttgtatctgaagcaaaaaagattattcaaacacaacaacaatattatcctgatattttgacggatatatttgaaactaagtatttagaaattctagaacgtaaaagagaatattttgtcggacctggtagcgaaaaatctagaactgattttggtatctataagaaagatggtagaactttggataatttgttcgaagagttaattggtcatgacaaaatatatcctgatgagttacgtgcgtctggtgcatcttatactgcacaggtttttaatgtcttaaatgatttaaataatttacgtatttctagttatgaaaacgggaaaatttctacggaagataaaataaagattgttgaagatttaagaaacaatatcggcaatgtaattataatgaaaatcattaaaaaggttgccggttgtgaagatgatgatattaaaggctatagattggatagcaaggacaaaccggatattcattcaatggccgtttatcgaaaagttcatcgtgatttattgaaatatgatgtggatattattaagtggccaacggaatttattgatgaattaagtccaatattaactttgaatacggagaacggtgaaattcggaaacaaatggtcaataagttgcaaccaaagtattcatttttaacggatgaacttattcaagttattattaataacaaatctagttttgacgttacttccaataataaatggcatcgtttctcattgaaaacaatgaatgttttgatcgaagaaatgttcagacgaccagttgaacaaatgactcttattcaagaactgggattgattaaagactcaggtaagagatttgaaaattgtaaacttttgccatatagggaaatctcaaaggatatttttaatccggtagcgtccaagtcagttcgtgaggctcttaaaattgttaatgccgtaatgaagaagtatggtcaaattgattatctggttatcgagatgcctcgtgataagaatgaagaagaaatgaagaaacaaattgaaaaattccaaaaggaaaataataagcaaaaagatgaagcaataaatgagtttgttaaaaaaattgggaataagaatgctgttgatgatggactaagacgatatggtggtaaattatatttcaagattagattgtggtatcaacaagatggaattgatttatataatggcaaagtaattgaaccgtttgacttattgaataatattaataaatttgaagtggatcatattattccagaatcaatttcatttgacgacagtattaataacaagacactttgctatgctgatatgaatcaaatcaaaggacaaaagacaccgtttgaatttatgaacgagggacatggccagggctttgcaaaaatgaaggctatggtaaataagaattcaaagttaaaaggtaaacgaaaaaattatttatttgatgaaaatattagtgatattgaaaccagaaaaaggtttatatctcgtaaccttgttgatactcagtattcgtcaagagtggttttgaatagtttgcaagagttctttaaggaaaaagaaaccggaactaaggtgactgtcgtccgaggtaagtttacttctaatttacgcaagcattggcatatcaataagacacgtgatacatttcatcatcacgccatcgatgcatcaataattgccgcgacaccatttttaagaatttggaaaaaagatgccagtttattccccatgcatgtctctgaaaatactgttgatattgaaactggtgagattcttaatgatactgaatttaaaaaagacttttacggattaccgtatagcagttttattgaagaactgaacggtgctgatgaccggattaagttttcgcatcaggttgataggaagatgaatcgtaaggtaagtgatgcgacaatttattcgacacgtaaaggaatgttgaataaagataaagaagaaactgattatgtcttgggaaaaatcaaaaatatttatgatgttagtgagtataacaaattcaaacgaatttacgataaagatccaaataaatttctgttggctcatcatgatccaaaaagctttgatgaacttagaaaaatcatgcaggaatatcctagtaaaattgataaagtaatgactaatggtaaagtaaaatctgtggatatttctccatttgaattgtatcgtcgcaaacatggaatggtacagaaatactctaataaaaataaaggccctgttattaaacaacttaagtatttagacaagaagttgggatctcacattgatattactccgaaggatacattgaatgataggcatgttgtattacagtcactgaagccgtggagaactgatgtgtattacaatagtgtgaccggtgaatatgaaattatgggtattaagtattctgatttgaagttcaatggtggtgagtatggaatcaagatgagcaaatatttggaaataaaagagcgtgaacaggtttcagatgagtctgagtttctgtttactctttataagagagatagaatccaaattataaattgtgaaaatgacgaaattgtagaaatgcttttctggtctagaaataattctaatattgggtatgccgaacttaaaccggtgtataaatataaaactgaggatgaaagttggccggtatacggatatggaaaaaatcaaatcctaaaaagattggtaccaaagaattgtaaaatattgaaagtaaataccgatatactgggcaatccatactatattaaaaaagaatccaaaaacccaaaaaatattcttgattaa

SEQ ID NO: 333 - DNA, 2700 bp, Lactobacillus nodensis DSM 19682B
atgaatagaaaaacgaccaaatttaacattgggttagacattggtaccggctccgttggctgggcagttacagatgataattacaatttattgcatgcaaaaaagaaaaacctttggggagtacgtttatttaatacagctgaaacagcggctgatagacgacttaatcgttctgctagaagacgttatcgcaggcgtcgcaatcgtttgaattggctagatgaaatatttgcggacgaattattccaagctgatcctggatttttgaaccgaatgaaacactcctgggtgtcaaagaaagacacagcaagaactcgcgatgaatacaacttattcatcgataaagaattcaatgacaaaacctactttgacaaatatccaactatctttcatttaagaaaacatctaattgaggatacacaaaaagctgatattagattagtttatttagccatccataatatcctaaaatatcgcggtaacttcacttatgaacatcaaaatttcgatgtttcgaagatgaatgaaggactcgaaaatactctctcaaacttgaataactcattagacctgttcggattaaaattacctgacgatgccgacttcaaaaaaatcagtgaaatactactagaaaaagattggagtcccagcagcaaagtcagcagcatcatcaccttactaaagcctgaaaaggatatgaaacaactatacaagcaaatatttactttattagttggtaacaaagctgacctaacaaaattatttaatatcgattctgctgaaaaaatcactattagtttttcttcaaatacgattgaagctgacctaagtgatgctcaggaaaaactaactgatgaacaatacgccatcgttgaaatggctaatccaatctatagtacgatcgttctcaatgaaatcctcaatggtgaaacttacttaagctttgctcaagtaaccaaatacgaaaatcatcacgaagatctgatgaaattaaaagacttatggagaaacgattctgaccgtaaagcagttaaaaaagctcgccttgcctacgataagtatcttgatgatggtaaatacaatcttgacgatttttataaagatctcaaaaaatatctatctacaaaagaagacccatattctcaaagtgcattagaaaaaatggagaatcaccaatatctcctcaaacaaagaactagtgataatggagttattccattccaacttaacgaaaatgaattagtcaaaataatcgataatcaatcacaatattatccattcctaaaagaaaataaggacaaaatcctatcactgattaacttcagaattccatactacgttggaccacttcaaagtgaagataaaagtgacttcgcctggatggaaagaaaagctaatggcccaattcgtccctggaactttgatgaaaaggttgaccgtgaaaaatcatcaaacaacttcatccgtcgcatgactgctactgatacttacttgattggtgagccagtacttcccaagtacagcttaatttatcaaagatacgaagtgctcagtgaattgaacaatgtccgcatcaagagtactggtgaagaatcagataagggttcacgtctaaacgttgatgttaaacaacgtatctacaacgaactattcaagaagcatactactatttcaacaaaacgtctgacagattggttgagaaaagagagttattattcagcacctgagattcacggactagctgataaaaccaagttcctatctagtctttcatcatatcgtaagctagcaaaaatatttggtaacgacttcgttgacgattcaaagaacctcaagcaactagaagaagttatcgaatggcaaacagtcttcgaagatcgacagattcttaaattaaaattgaaaaactcaaaactttataccgatgatcaaatcaaacaactagcagcaattcgttatcaaggttgggggcgcttctcaaataaactactcacacaattattggttgaaacaaaagtcaatggtgaacacatgccaagtaaccactcaattctcgacttgatgtggcagaccaagagtaacttcatggaaataattagagaagataagtataacttcgaaaaacaaatcaaagactataacgttggtgatgcagccgacaagaagccactagatcttgtcaacgagctaccaggttcaccagctctaaaacgtggtatctggcaagctatcgttatcgttcaggaactatctaagttcatgaaacacgctcctgaacacatctttattgagttcactcgtgaagatcaagatagtggtattaccaaatcaagatacaatcaattagataaaaaatataaaaatattggtgatatggttcgtaacctagcacccaagttgaagaatactctatatcttaaagctcaactgaaagacaaaaaagacgctctatcaaatgagcgactatgttgtacttcctacaaatgggtaaaagcttatacagtgaagccgagattgatatcaaccgtctattcacgacagattatcaagttgatcacatcttgccacagtcatatatcaaggacgattcacttgaaaataaggctttggtcaaagcaagtgaaaaccaaagaaaactcgatgacttactcctaccaaacgatgtcattgccaacaacattcaacgttggcaacaactaa

SEQ ID NO: 334 - DNA, 4074 bp, Lactobacillus oligofermentans DSM 15707
atggctgcgaaaaactataatataggtttggatattgggacgagttcaattggctgggcgatagtggatgataattatcaattaatgcacgcaaagggtaagtatggatatggaacgcggatttatagtgaagggcaaacggcggctgaccggcgtggctttcggacaacccgacggcgcttgaatcgacggaagtggcgtttgcgattactccaggatttctttgaaccatatattttaccgcaagacgaggctttttttattcggcaaaagcaatctaatttagtccctcaagatactaaaaaacagtatccggagagtgtcttatttgatgatacttcagataaagatttttacacagaatatccgacgatttatcatttacgacaggcactaatgacggaaaaccggcaatttgatattcgtgaagtttatctagcaattcaccatatcgttaagtatcgcggtcactttttaaacaatgctcccgtaaaaacttttaaaagtggcaatttagatttagcaattaaatttaatgaactaaatgaagaatttaaaagtgtttatcctgacttagaattacagtttaatcttgatcagattgatgaaatcaaaaaaatactactagatagcactaaatcacgatttgatcgacaaggtgaagcagtgaagttaatttatacggtctcagaagttaaaactattgaaaaattgcaaaataagattgtaaagcaatttttgagtggtattttaggcttgaatactagatttgatgttctgacaaatactgagagtgatgattcaatgtggaaattttcactggattcagaaagctctgatgatgcattagatgagatcattgctcaactcgatgatccggctattcatgtggtggaattggtaaatgagattcattcttcaatcactttggctgggattgttcctgaaggccaaggcttatctgaatcaatggttgaaaaatacgaagcacataaagcacacttacaattgttgaaagccgttgaaaagttagttgataaaaaggctgcggataaattggaagtagcctatgaccaatatatcaatggtaaagacagcaagcagttcattaaagaagatttttataaagcagtccaaagtgaaattaaaggggtggccggggatgaagttgccgagattaatcagttaattgagctggaccaattcatgcctaaacaacggacgaaggaaaatggtgccattccgcatcaattacatcaacatgaattagatgtaattatcgaaaatcaatcgaaatattatgattggttaggcgaaaaagttggaaatgaatataagcttgataagttagtttcattccgggttccatactacgttggaccattggttgatactgcaagtaaagagaaaaaagatgagactagatttgcttggatggttcgtaaaaatccagaatcgactgaagcaatcaccccatggaattttgaagatatcgtggataagaatgcatcggctgaaaactttattaagcgcatgacgaccaaggataaatatctacttaatgaagatgttttgcctaagtgtagtttattaacacaggattttgaagtttataacgaactaaacaatattagagttaatggagaaaaatttactgccgaacaaaagcaattaattcatgatgaactatttacgaagcatgcaagtgtgtctattaaacaattgaaagattttctggttagtgagttaatgtatgtccgtgataatttaaaagtcgaaggtttggctgatgaaaagaaattaatgagtagtttatcaactcaatttgactatcaaaaaattattccagatcaaattaatgacgtgaagtatcgcgaagatatcgaacaaatcattgaatggtcaaccatttttgaagatgcggctatttttaaaactaaattaaaagaaattgattggctaactgatgaacaaaggaacaaattagctaacaaacggtatcgtggttggggtagtttatcgaaacggttattggcatgcttggttgatgaaaatggtcaacggattatcgatattttacgtgatagtagcgataattttatgatgattgttaatcgtcctgagtttaaacaagcaatttttgatgaaaatgctaatttaactgagaccaatagtaaaaaagatatgtttgaaatgattgataatttttatacgtcacctcaaaataaaaaagcaattcgccaagtattattagtagttcaagatattcaaaatgcaatgggtggcgtggcaccacaaaagatatttattgaatttgctcgtgaagatgaagtgaatggtcgtcggactaattctcgctatagccaaatccgtgaaatgtatagtaaggtcacagatgatgttataaataaaacagttcgtggtgaattagaagccaataagggttctcttaataaagaaaagctattcttgtatttccttcaaggtggaattgatttatatagtggaaaaacaattaatattgataatatttcgagttatgatgttgaccatgttttgccacaatcatttattaaagatgattcaattaataataaagttttggttaatgctaaaggtaatcgagttaaaaatgacaacgttccgatggaattatttggtgccaaaatgtacccaacttggaaacgaatggttgacactgggataatgtcaaaagctaagtttaaaaatttgaccttgaaccctgataatgttgataaatttaaggcagagggctttattaatcgtcaattagttgaaactcgccagattattaaattagttgcccaaattttaaatgataaattgggtgatgatactaaaattgtgtcggttaaagctaatttgacccatgatatgcgggtattctttgattttcctaaaaatcgaaatgttaataactatcatcatgcgtttgatgcttatttatcagcgtttgttggtacttatttatataagcgttatccgaaattacaaccatattttgtctatggtgaatttaaaaaaatggataaacttaaaaacatgactagttttgatttcttacgagatttaaaacacaccgataaagttgtcgataaagataccggtgaaataatcgctgataaattagcagtaattaccaatatgaataaaatttatgacttcaaaaaagtattggtgacacatgaagtacatgaaaatagtggtgcgatgtatgatcaaaccctttatcccgctaaactagataagtcacttggtcgaaaaggcgctaaacaactaattccgaaaaaagatgatatgccaactgcattgtatggtggctataccggctcaaaagatgcctttatgtcgatcgttcgtttgaaaaagaaggatgaagtttattataaagttatcggaatccctgttcggattgccgattcagttcaacatggcaaagaagttgatgttgaagcactaacacagtttattgaaactaaatttaccaaagaaaatttaaataaaaaaactggtgaaattactcgtaaagttgagtggtttgagttggtattgcctaaagtgctatttggacaggcggtatttgatggtgggcagccatttatgctgggatcatcaacatacccacataatttaagagagctagtcttaactaaagatagtgttaaaaaaattgcaggtaaagaatcaaataagtcgtacttagatgcttatgatgaaattatggaggccatgaataagtattttccactttatgatactaataaatttagagaaaaggttattgaaggaagatctaagtttattgatttacctgataaagatgagtacgaaaacaacaaattagtacaagtaggtaagtctactattattgatcgcatgtttattggtttgcatgcaaatgctgcaagaactgatttgaaaaatattggaataactacaccatttgggtttatgcaacaagcaagtggtattaaattaaccaaagatacagttgttttgttccaatcttcaactgggttatttgaaaggaaggttgccctaaaggatttatag

SEQ ID NO: 335 - DNA, 4188 bp, Lactobacillus otakiensis DSM 19908
atggttattagttcatgcataataggtgatgtgcctaaaggggttactgggcaacattattttgaggagttttatcgtatgaaagttaataattatcacataggtctcgatatcgggacatcatcaattggttgggtcgcaatgggggaagacggcaagcctttacgcgttaaggggaagacggcaattggtgctcgattattccaagaaggcaacccggctgctgatcggcggatgttcagaacaactcgtcgccgtttgaacagacgaaagtggcggttgaaattattggatgaaatatttgatccatatattacacctgtggacagcaccttctttgcccgtttaaaacaatccaatctgtcgcccaaagattcacgtaaggaattcaagggctcaatgctgttcccggatttaactgacaaacagtaccacctagattacccaaccatttatcacttacgtcatgcgctcatgactcaggataaacagttcgatattcggatggtgtatttggcaattcatcacattgtcaagtatcgtggaaatttcttaaattcaacaccggtggattccttcaaggcatcgaaagtgaattttgatgatcaatttaaaaagttaaatgaattatatacagcaatcaatcctgaagaatctttccaaattaatctcgcaaatagtgaaaagatcggccaacaattccttgacccatccattcgtaagtttgataagaaaaagcaaattccaaaaattgtcccggttacaatggacgataaagccgtggacaaacttaacggcaagattgcttcagaaatcatcaatgctattttaggatataaatccaagctggatgtggctgtgcagtgtgacccagaagattcaaatccctgggcagtgaaatttgatgatgaagatattgatgccaaactgcagaaaattttacctgaaatggatgaaaatcagcaatcgatcattgggatcattcaagacttgtattctcaagtaaccttaaaccaaattgtcccaaatggaatgtcattatcagaatcaatgattaaaaagtacaacgaccaccatgatcacttgaagttatacaaaaagttgattggtcagatttcagattccaagaagaaaacagcattgaagaaggcatacgatcaatatgttggcaacgatggtaaagtcatcgaacaagatgacttctattcgagtgtgaaaaagaatttggatgattcagagttatcaaaacaaatcatggatctgattgacgctgacaaattcatgccaaagcaacggacatctcaaaatggtgtcattcctcatcaactccaccaaagagaattggatgaaatcatcgaacaccaaagtaaatattatccttggctggcagaatctaaccctaacaagcatgatctgcacctggcaaaatacaaaatcgaagaactggtcgcctttagaatcccatactatgtcggtccaatgattactcctgaggatcagaaaaagtctggggccgcagtcttttcttggatgaaacgcaaggaaccaggtcaaattacgccttggaactttgatgagaaagttgatcgaatggaatctgctaacaaattcatcaagcggatgaccacaaaggacacttatttgattggtgaagatgttcttccagatgaaagtctgctgtatgaaaagttcaaagtgcttaatgagttgaacatggtccgggtgaatggcgattcgctgaaggttgccgacaaacaggcgatttatcaagacctgtttgaaaactataagcacatttccgtcaagaaactgcaaaactatatcaagggtaaaaccggattgccaaacaatcccgaaatttcgggattatccgatcccgatcagttcaataattcgctcggaacatacaacgacttcaaaaagttgttcggcgataaagttgacgatccggatcttcaaaatgattttgaaaagatcgttgaatggtcaactgtcttcgaagacaagaagattttacgagccaaactcaatgaaattacctggttgaccgataagcaaaaggatgatcttgagtccagtcgttatcaaggctggggacgactttccaagaagctcctgaccggaattgtgaacgatcagggtgaacgaattattgacgagctttggaataccaacaagaacttcatgcagattcaatccgatgacgattttgccaaacgaattcatgaagccaatgctgatcagatgaagtctaccaacatggaagatgttttggcagatgcctacacgtctccgcaaaacaagaaggccattcgtcaagtcgttaaagtggtcgatgatattcaaaaagcaatgggtggtgttgcacctaagttcatctcaattgaatttacccgttcagaagaccggaacccgcggcggacaatttctcgccagcgacaactggagaacaccttaaaggacacggcgaaatcgctggtaaagtccatgaatccaaacattttgtccgagttggataatgcgtcgaggtctaagaagggtctgactgatcgtctgtacctgtactttactcaacttgggaaggatatgtatacaggtgagccaattaatatcgatgaaattagtaattatgatattgatcatatcttgccgcaggcgttcattaaggatgactcgttgagcaaccgcgttcttgtatcaaaggcagtcaacaatggcaagtctgctaatgttccattgaaactgttcggtgccaagatgggccacttctggaaacagcttgctgaagcgggcttgattaataaacataaactaaagaatcttcaaacaaatcctgacactattagtaagttcgcgatgcacggtttcatcagaagacaattggtggaaaccagccaggtaatcaagctggttgcgaatattctcggtgacaaatatcgaaatgatgataccaagattatcgaaattacagctcggatgaaccatcagatgcgagatgagttcggctttatcaaaaaccgtgaaatcaatgattaccatcatgcctttgatgcttatctgaccgcattcttagggagatatttgtaccaccgttatatcaagttgcgtccatacttcgtttatggcgacttcaagaagttcagagaagataaggttaccatgcgtaacttcaacttcctgcatgatttgacggatgatactcaagcaagaattgcagataccgagaccggtgaagtgatttgggatcgggagacttcgattaagcagttgagagatgtttatcattataagtttatgttgatttcgcaagaggtttatacacttcgcggggcaatgtttaaccaaacaatttatccagcatcccaggcaggacggaaaaagttaattccaatgaaagccgataagccagttgacgtatatggcggatatagtggcagtacggatgcatatatggcgattgtccggattcatgataagaagggtgataagtataaggttgtcggcgtgccaatgcgggcgctaaatcggctgaacactgccaaaaatgtgagtgatgccaaatatgaccaagagttgaaagaagtcttgacgccacaatttaccaagtccaagaaaaaccggaaaactggagagatcactcaaacagttgaagactttgaagttgtcttaggtaaagtgatgtaccgccagcttgtgattgatggcgataagaagttcatgcttggaagttcaacttatcaatataacgcgaagcagctggttctttctgatgaatccattaagacccttgcaagcgaaggaaaactgaatgaggcgcaagagagcgctgcgtatgataaggtttatgatgagatcttggataaggttaataaatactttgcgttgtatgataccaacaagttccgtcagaaactaagcctgggtaaggacaagtttgtgggacttcccaatcataacgtgtttgatggaagtaagaagatatcctcaggcaagcgagagattctaaacgaaattttgaacgggttacacgcaaatgccacactgggtactttgagcgatattggcttttcaacaccatttggcaagatgcaacagcctaggggaattggtctgtcttcaaatacaagcattgaatacgagtcatttactggactgtttaagcgaacaatatttttaaaagatctataa

SEQ ID NO: 336 - DNA, 3237 bp, Lactobacillus ozensis DSM 23829
atgcataaacattataaatatgcgttaggtttagatgttggagttggttcagttggttatgctctacttaaactagatgaagctgatcaaccttgtggattgcttaaggctaattcagtgacttttccaatgtcccaagaccgcacaggcaatactttggcatccattgctcgtaattatcgaagtggtcgacgtttaaaccgtcgtcgtaaattaagaaaacagttagttagtaatttattcactaaaaatggattaataaatcgtaatgatgtatatagtccttatactaagcatcccaattttgatttatatcggatttggcatgatagttttaatcagcaaatatccaatcaagatttatatcgcctactatattattttgccggtcatcgtgctttcaagtctaatcgaatccatcaactaaaaagttctggtgataaagatacgactaagctacttagttctattgacaccaataaagaatattttaacaatagtcaatataaccatttaggtgaaatgttttactgtgaccctaaatttgctcaacgtaaacacaataagggctatgatgatggatatttattcaatattgatcgtggtacgttgttaagtgaaattaaagagatattaaatgctcaatcaaaatttggaaatcctgctatcaatgatgatttcaaagctcgatacttaaaaattttgagtcaacaacgtaattttgatgttggccctagtaatccatctagatttgctttagttgacagttcaggaaatattaaattaaggaacaaaaaagataaattaaatttatcattcaaaactagtgctaaagccagttatacttttcaaaaatttcagattttacaaaagttagctaacacccgttataagttaaattcacaatccaaatatcaatctctcaatgctgaaaccattgataagatttttaataaagctataacgaaagctaactataaatatagtcaacttaaaaaagatttgaaattaccagattcagctcgctttaatatggttatgtatgaaactagcgatgataaatctgctaaacaagctgagactaaaacgtttattataaaagataatacctactacatattatccaagatattgtcagataaattgcagcatgattatacggtaattgatcaaatagcagaaatacttactaggtataccagtgatgaacctaaagcaaaggctttaaagagacaattaggtgaaaaactatctgatgaaaaaatagaatctttattggctctaaactttactcaatatggtagctattcaatcgataccatgcagtgcttaattccctatttagccaaaggatacgatgtaacaactgcgattgatgcatttaatgaagaccaagcatcattagaaaatggccatagcccattgattgatgccagtatgaactaccatgaaataattagtagtatcaagaaccctgctttattacagtcatttaccaagacagttaaggtggtcaaagcacttattcgtcgatacgggaatccatataccattcacatcgaaatggctcgtgagttgagtttaggtaacaagggcaaagctgaattaattaagaaacaaaacgaaaatcgtaaacgcaatgataaagttattaccgaaatgaaagaaaattttcccaatgtttcgattaatggtgaaaatattattaggttaaagctttatcatgaacaaaatggaattgatatttatgacggtcgaatgattgattaccaacatgtcttagataataattacgaagttgaccatatcttgccttacagcattagttttaataatagttttaataataaggtattaacctctagtcgtaataatcaactcaaacgaaatcgtaccccttatgaatggttacacaacgataaagttcgttgggatacattcacgtcgattgctgaaaatgtaagaaattatcctaaaaagaataacttattaaaaatgcactacgatgaaagtgacatgaagaaatggaaaacacggagtttaaacgatacccgttatgccacccgattgctatataactactttaaacataatgagcaatattttgatgcaaagccttcagtcatgacaatgaatggtagcatgacggcccaattacgttattattggggaattgttaagcaacgtgccgctagtgataaacatcatgcggtagatgcttgtgtgattgccacttgttctaattcaatggttaatctaattagcaagtatcatactgctcgtgaaaaagaacagttatcctctaagttccctatgccttggccagatttccgcaatgacgtgatgaatgctaagcaacagatgaacgttaaaagaatctttagccacagtattgctggtaaggtgaacgaggatggactaaaaggtgccagatacatcaacaccgataaagtagttgttatacatgaaaaactagctaatttaaagctcaaaaaagttggcgatgattatatcattgttggacacggtaattctcgctatttgcgtccagacgatttaaccagtatttcaaatcgtaatagtaaaaatgacttgaattcggtcatttatgaccatatttataatgctttatctaaggataaaaaagcttttgaaaagcaaccttatttggaatttgagcataagggacataagtatactgttagaagagtaaaagtgattagcgactataagggtggtgtcattttaaatcgcgatgcggatggtaaccctatttcagtggcaaaccgtggtaagatggtgcgcaacgatatatttaaatgtctcgataagaaggaaagagtcgtataccgttttgtccccatttatgagcatcaaattttagatacacacttacctaatcaatatgctccatttgctaaaaatatttttgtgaatgataaagaccaatttatttgttctttgagtaagggggatgcggttgaagtgaaacttagcactcctaagaaagtagaaaattgtgatgagccatatgtatgtgatcattttattggttattttgatggatcagatatcagtagtaatcgaataaaaattaatgcattagataattcttgttcaattcgcgcctctatgagtaaattgattagcattcaaaaatgtgatgttaccatttttggtagtattcataaggtgcatgagaaagtgcgtcaacctttcaacttgaagcataaataa

SEQ ID NO: 337 - DNA, 4089 bp, Lactobacillus paracasei subsp paracasei 8700:2
atgacaaagttaggtaaaccatatggcattggagtcgatatcggctcaaactcgattggatttgcggctgtggatgagaacagtcatcttattcgattgaagggaaaaacggttattggggcaagactgtttgaagaaggaaaagcagcagcgaaacgccgagcaggtcgtaccactcgccgtcgtttgagccgaaatcgttggcgactcagttttttgcgtgatttttttgaatcgcatattacgcctactgacccgaatttctttatgcggcaaaagtactcggaaatctcgccgaaggataaggcccgttacaagtatgagaagcggctttttaatgatcggacggatgctgagttttatcagcaatattcgacaatgtatcatttgcgcaatcggcttatgactgatccaagcagagcggatgttcgcgagatttattttgccattcatcatattttgaaaagtcgcgggcattttttgacgccgggagatgccaaggatttcaatacaaacgatgtggcgttagacgagatttttcctgcattgcaggatgcctacgcccaagtttacccagatcttggcattacttttgatgaggacaaagcgaatgagtttaaaacaattttgctgaatgaaatagcaacgtcaattgatacgcaacgagctttagtcaaactgttactggctgaagaagacgacaaggacatcttgaagcagcagaagcaggttttaaccgagtttgctaaagctgtggtcgggttgaaaaccaaacttaatctagcgttaggaactgaagttgatagttctgaagccactgcttggaacttttcattagggcagcttgacgataaatgggctggcattgaatcggctatgaccgatgaaggaacggaaattctggaccagattcgggatctgtatcgagcccggctccttaatggtattgtgcccacaggaaagacgctttctcaagctaaggttgatgattatacacaacatcatgaagatctccagttgtttaaagcctatttaaaacaacttgaagatgatggaacggctaaagcaatccgacagctttacgatcgctatatagacggtgacgatgctgcgccatttttgcgagaaaattttgttaaagcgttaactaaagacgtgacggctcatccaaacaccaagtctcctgaactgcttgaacgtttggcgcaaccggacttcatgctcaagcagcgcaacaaagcgaacggggctattccagtccaaatgcaacagcgggaattggatcagatcatcaaaaatcaagctgtttattacgactggctggctgcgccaaatccggtggaaaagcatcggaaaagtatgccttatcagttggatgaattgctgaattttcgaattccatattatgttggaccattggtgacggctaaagagcaaaaagcagcacaaggcggggtttttgcttggatggttcggaaagatcctgaaggtaatatcacgccttataattttgacgaaaaggtagatcgcgaagcttcggctaatacctttattcagcggatgaagacgaccgacacttacttgattggtgaagacgtgttgcctaagcaaagtttgctgtatcaacgctatgaggtgttgaatgaactgaataatgttcgtgttaataacgagaagcttagcatcgaacaaaaacaacaagttattcgagaactgtttgaacggcataatagtgtgacaattaaacaatttgccgaaaatctgcgagcgcacggtgattacgcccacattcctgaaattcgtggtttagctgatgagaaacgttttttaagttcactttctacgtaccgtcaactgaaaagtcttttacccgaggcaattgatgatccagccaaacaagccgatattgaaaatatcattgcgtggtcgaccgtttttgaagacgcagcgatctttaaaacgaaattgaaagagatcagttggctcggcagcgaagccatcacgaaactaagcaacattcgatatcgggggtggggccagttttcgcgcaagtttttaaatggtctgacccttggcaacgggcatactatcattcaagaattgctcctgtccactaacaacttgatgcagatactaacagatgaaacgctacaaaagaaaatgaccgagctgaacgctgataaattgaaaacagcgaatatcaatgatgcgattgataatgcgtatacatcaccaagcaataaaaaggcattgcgtcaggttcttcgggttgttgatgatattaaacgcgctgcggatggtcaagatcctagttggttgtacgttgaaaccgcggatggcggtggtacaccaggcaagcgcactcgtgcgcgtcaacatcaacttcaggaaatatacgcgaatgcggcccacgagctgattgatacggcagtccgcggtgaattggaagataagatttcagataaggccgatttcaatgatcgactagtgctgtatttcatgcaaggtgggcgtgatatctacactggtgcgccactaaatattgatcaactaagtagttatgatatcgaccatattctgccacaatcgctaatcaaagataactctttagataatcgtgtattagtgcacgctattatcaaccgagagaaaaacgcaacatttgcatcaaccatctatgctcaaaagatgaacgcgacatggcgtcaatggcatgaggcagggctgattagcggtcgcaaactgcgtaatctgcaaatgcgtccagatcaaatcgataagtacgcgagcggctttgttgcccgacaattggtggaaactcgacaaatcatcaagctgacggaacaaattgtagcagcgcagtaccctgataccaaaattatcgccgttaaagcaggtctttcacatcaattgcgggaagaactcgaattccctaagaatcgtgatgttaatcactaccaccatgcttttgatgccttcctagccgctcggattggtacctatttactcaagcgattccctaatttacaggctttcttcacgtacggcaagtttacaaaagccgacgtcaaaaagcttcgcgggttcaactttatccgtgatatcacacatgctgaagataaaattgtggcaaaggataccggcgaggttgtatgggacaaacaacgggatgttgatgagctggatcgaatctataactttaagcggatgttaattacgcatgaagtccgctttgaaacggcggatttgtttaagcagacggtttatggggccagggattcgaaggaggctggcgggtcgaagcagctcattccaaagaaaaaaggatatccagttgatatttatgggggctatttcagagagaacacggcctatcttgccgttgtgaaagtgaccaaaaagacagagacaatctttaaagttgtcaaaattgcaacttcccaggttgcagctttgaataaagcaagatcacggtcaactgctgaggagctttcagtacttactgaactcctaaagccaaaatttagcaaggtcgggaaaaatggtaagatcactgatacaccattcgaggttgtgcttccgcgagttccgcgtgaacaacttttctataatgcaaagtatggtttctttatggttaactcagataccatgtttcacaatttccaagaaatttgggtgtctcgttcagaccaaaaaattcttcaacaaattagaaaagccaagattgactatcctaatgttgatcaagatttagacaatctttttcacaatttagccgatcaaattgtcaaatattttgatttgtattctattgcagggtttaaagagaaaatcagtcaaagtcaaaatactttcaatgatttggcggttgatgatactgaccagagtgtaggtaagataacggtcattaatgaattgttaaagggagcacaagctaatggcatgacgggaagcctaaaagttttaaagataagtaccccatttggatttacgcaagataaaagtggtgttcttacaaaagatagttccatcatctatcagtcaccaacagggctttttgaacggtctgttcgcctaactgacctgtaa

SEQ ID NO: 338 - DNA, 4089 bp, Lactobacillus paracasei subsp tolerans Lpl7
atgacaaagttaggtaaaccatatggcattggagtcgatatcggctcaaactcgattggatttgcggctgtggatgagaacagtcatcttattcgattgaagggaaaaacggttattggggcaagactgtttgaagaaggaaaagcagcagcggatcgccgagcaagccgtaccactcgccgtcgtttgagtcgaaatcgttggcggctcagttttttgcgtgatttttttgaatcgcatatcacgcctactgacccgaatttcttcatgcggcaaaagtactcggaaatctcgccgaaagacaagtcgcgttacaagtatgagaagcggctttttaatgatcggacggatgctgagttttacaagtatgagaattgtccgacaatgtatcatttgcgcaatcggcttatgactgatccaagcaaagcggatgttcgcgagatttattttgccattcatcatattttgaaaagtcgcgggcactttttgacgcctggggatgccaaagattttaatacaaacaaggtcgcagtaaacaagattttccctgcattgcaggatgcctacgctcaagtttatccggatctggacatcacttttgatgagaacaaggtgaatgagtttaaaacagttctgttgaatgagaaagcgacgccaagtgacacgcagcgagctttagtcaatcttttgttggctaaagaaggcgacagggacatattgaagcagcagaagcaggctttaactgagtttgctaaagcagtggtcggactgaaaacgaagctcaatgtggcgctagggaccgaagttgatagttctgaggccactgcttggaacttttcattagggcagcttgacgataaatggacaggcattgagtcagccatgactgatgaaggtaccgaaattctggaccagattcgtgatctttatcgagctcggctccttaatggtattgtgcccgcaggaaagacgctttctcaggctaaggttgatgattatgcacaacatcatgaagacctcgaattgttcaaagactatctaaaacaacttgaagatgatggaacggctaaagcaatccgacagctttacgatcgctatatagacggtgacgatgctaagccatttgtacgtgaagattttgttaaagcgttaactaaagaagtgacggctcatccaaacgccaagtctcctgaactgcttgaacgtttggcgcaaccggacttcatgcttaagcaacgcaacaaagcaaacggggctattccagtccaaatgcaacagcgggaattggatcagatcatcaaaaatcagtctgtttattatgactggctggctgcgccaaatccggtggaaaagcatcgaaaaagtatgccttatcagttggatgaattgcttaattttcgaattccgtattacgttggaccattggtgacggctaaagagcaaaaggcagcacaaggcggggtttttgcttggatggttcggaaagatcctgatggtaatatcacgccttataattttgacgaaaaggtagatcgcgaagcttcggctaatacctttattcagcggatgaagacgaccgacacttacttgattggtgaagacgtgttgcctaagcaaagtttgctgtatcagagttatgaagtgcttaatgagttgaacaatgttcgggttaatgacaataaattaagctttgaccagaagcagcaggtcttaggtgaactttttgaaaggcataacaccgtcactattaaacagtttgttgacaatttacttgctcatggggattatgaccgcattcctgaagttcgtggtctggctgatgagaaacgctttttgagttcgttgtctacttataatcagcttaaggggattttgcatgaggcaattgacgactcggataaacaaactgatatcgaaaatattattgcttggtcaacgatttttgaggataaggcgatttttaaaacgaagcttaacgaaatcagttggctaaatgctgggatgattaacagtttagccaatattcgttaccggggatggggacagttttctcataaactattaaatgagttaacgctcagtactgggcgcacagtttttgaagaactacttatatctagtcataacctgatgcaaattttgacagacgaggtactgaagcagaaaatcgccgagttaaatgctcatgaattaaaagcatcaggtatttatgccgcgattgatgatgcttatacgtcaccgagcaacaagaaagctttgcgtcaggtacttagcgttattgatgacatcacaaacgctgctgggcaagctccaaattggctctatattgagacagcggacggagacggagtacccggaaaacggacgaattcgcggcaacgaaaaattcaagagatctatgcaaatgctgcccaagaactgattaccggcagtgttcggggagaacttgaagataaaattgccagtagagctgactttacggatcgcttagtgctttattttatgcaaggcggccgtgacatctacacaggcaaaccattgaatatcgataatctaagtagctacgatattgatcacattctccctcaatcgttgattaaagataattctttagacaatcgcgttcttgttcatcccctcgtcaatcgcgaaaaagatacaatcttcgcttcgacgcgattcgccaaacaaatgaatggaatgtggcgtcaatggcatgcagcgggattgattagtagtcgaaagctgcgaaacttacagatgcggcctgacgaaattgataaatacgcgagtggatttgttgctcggcaactggtcgaaacgcgacaaattatcaaactcactgaacaaattgtggcggatcaatatccagacactaagattatcgctgtcaaagcgggactttcatctcagttacgcaaagaactggactttccaaagaatcgcgaggtaaatcactatcatcacgccttcgatgccttcttagctgcgcgtatcgggacgtatctgctcaaacggtatcctaatcttgaacccttctttacctatggaaaatttaaaaagacggaagtaaagaaattaaagagcttcaactttattcgtgacatgacacatgcaaaagataaaatcgttgccaaagagaccggagagattgtctgggataatgcaagtgatatcaatgagttggatcgtatttacaatttcaaacgtatgttgattacgcatgaggtgcggtttgagacggcaagtctatttaaacaaacactttatgcagccaaaaattcaaagaatcgcggcggatcaagacaactaattccaaagaaaaaggggtatttagttgatatctacggaggatatacgcaagaaacgggtagttatttatctgttgttcgactaacaaaaaaagcgatgtacgctgtcgtgaaagtatcgacgagagatgctgctaaattggcagttgctaagagtatttctgagcaaaaggaaaatgaaacgttaaaaaagattattgatggaaagctttcaaagacaagcaaaaagggaaaaaccacacatcaattatttgagattgttttacctcgggtggggcaaaagaccttatttaaaaatagcaaatacaatcaatttctagttaattcggatacctacatgcacaattaccaagaactgtggatgccacgtgagtatcagagaatgtggaaagatattttgctatctaatcacggtgatgctcagttagaaggccagttagatcaaattttcaagtttattgtttctcaagtgaacagctactttaatctatatgatattaatcaatttcgtaaaaaaatagccgacgcaactgataagttcgctaaacttccaacgcatgatacagataacgcacgagggaaaattgcgacaataggtcaattgttaattggccttcaagcaaatgctatgagaagtgatttaaggaatctcgatataaaaacacctttcggattattacagattggtacaggaataaccttagacttggacacctccattatttaccagtctccaacaggtttgtttgaacgagaagttcccttaaccgatttgtaa

SEQ ID NO: 339 - DNA, 4107 bp, Lactobacillus paracollinoides DSM 15502
atggataagaaatatagcattggcttagatattggtaccagctcaatcggatttgtcggggttgatgaaaacggttggccactaaatatcaaagggaagcgggcaattggtgcacatttgtttagagaaggggaagcggctgctgaaacgcgtggtttcagaacgacacggcgccggtacaatcgccgaaagtggcgattgcggttactcagagagatatttgatgaacctatcagtcgggtagatcctactttttttgctcggatgaaagaatcctcagtatctccaaaggatcctaactatgacggtttagcgaaagaaattttgattccaagagataaggatggaaagattctttatccgacaatctatcatttacgtcacgcactgatgtatgaagatcaccaattcgatattcgtgagatttatttagctattcaccatatcgtcaaataccggggccactttttactggacggtgcggctaagaactttgagtcctctaatcttgatctaaaaagtgacattcacgaaataaatgctattttagtaggcatttttggtaatgaacaggtacagtttaatgatcaatacgttgaaaaattaaaggaagtgctactggatagtacccaatcacgttcagatcgacagaaagctgctgcaaaattgttgttgccaacaaatgatttagacaaagatacaacgaaaattctaaaaacagtttcaactgagattacgaaagccatcacaggattgaaagcaaaattttttgtgataaccggcaatgatatcgcaaaagaccaacaaaaggattggacttttagcattgatacattggacgaaaaaatgagcgttattgaaccctcattctcagaaaagaacttttccttaataacaattctacagaaattgtattctagtgtgacgctggctggaatagttccaaatgggcttagcctatccgaagcaatgattcagaaatatgataggcatgcgtccgatttagttttgctcaaaaagtattgggacactaagccaaaagttttgaagcaccagcttcaaaacacttatgcagaatatattgaaatccatcaggtagttgatgagttctacagtgatcttagtaagttaattaaaaatgatgatgacactctagcgcaagaaatcaagtctaaaataacgattggaaattttttgccaaaacaacggacaaccgaaaatggtgtaatcccatatcaattgcaacaaagagagttagatacaattataaaaaatcaacaagaatattatccatggttagctgaggagaacccagtcgctgaccatcaaattgcatttccatacaagttagatgagctagtcggattccgaattccctactatgtaggaccgatgatagcgaaggaagatacttccaattcaaagaatagtaaatttgcctggatgattcgtaaacagagtggtgaagtaacgccttggaacttcgatgaaaagattgatcgcacagcgtcagctactgcatttattgatagaatgacaactaccgatacttatttaattggtgaggatgtattgccaaaacaaagtttaatctatcaacgttttgaagtgctaaatgagttaaataagatttctatcgatgggcaacccattactcgtaaacaaaaacagagtgtatatacacacgtatttgaaaagaagaaaacggttcaggttaaggatgttcaaaaatttttggttagctcaggagaggttatgagtttgccaaagattggtggtttagctaatgaaaaacaattcaatagttcactatcaacgttatatgattacaataaaataattcctgacgcacttgaagatagaaataaagttgatgatatcgaaaaaataattttatggtcaactatttttgaagacaactcaatttttgtggaaaaactggattcaattgactggttaactagcagtcaaaggaaaagacttgctcaaaaaagatatcgtggttggggtcgattgtctttacgattactcacaacttttaaaaataaagatggttacagtatcttagatgaactgtggaactctaatcataattttatggaaattcaagcacaatctgatttttctgaacaaatcgcaacagcaaacaataataatttgagtcaagttcttcctgccaaatgggaacctggacgcaagaatttggcatcgttggatgaattcatttctaatctgtatacttctcctcagaataagaaggccttgcgtaaggctatcagagtggttcaagatatgatgacagcagccggccatatgcctgaaaaaatctttattgaagtcgcacgtgacacgtcaaatagtcaccaacaaacaattgctcgccaaaggcaattacaacagctttatcaatcggaagataaggaagtcattgattctagtgttcgtagtgagttagacgatattttaaaaaatcgagctaatatcaaagatcaattattcctgtatttccaacaaggtgggcgggatctttatacaggaaaagcaattaacattgacaaattatcgctatatcatattgatcatatattgcctcaatccttggttaaagatgattcattagacaatcgcgttcttgttagtcaaaaaaccaatgaggacaaaggtgttacattcgtctcagataaatacatgaataacatgttgccaacctggaaacgatggcatgaaatgggactgatttctgccagaaaattaaaaaatctaacgatgagaccagatgaaattgacaaatatgcacccggttttattcaacgacaattagtagaaacaagacaggttacaaagctagttattgaacttcttgatgctttattaggaaacagtcaaacagaaatcatcacaattaaagcgtcactttctcatcaattcagacaacagtttgatctcgttaagatccgtgaagtaaatgataatcatcatgcatttgatgcttttctagctgcgcgtatcggcacttatctatataaaaggtatcccaaactgcgaccatattttgtgtacggtcagtatatgcaaaatcataaaaatttaaaaagtatcaatctaataaagacgcttgattctgataaagcaattgttgatgaaggtactggagaaattctatgggataaaaagtcggacttagctaaaatgataaaaatatataattatcaacgtcttttaatcacccatgaaagtcgtacaagcttcggggcaatgtataagcagaaaattttaaaggcaaccgacgcaaaacaaaacggtggaggtttcaagttggttccaaccaaacgtaatcggccagttgatatttatggtggttacactggtcagactgccgcctatttgacaattgtcagagtctattcaaaaaaaacatctgaacttcgagttttgccaatctatacaaataaggtacagcaaatagagaaagcgatgacgcaaggcgataaagctactatgttagcatttaaaaaagtcattgcacctcaattaggtaaagaaaataaaaagacacatgaaataaaaatccctgaatttgatgttgtgattcccaaggtcttactagatcagttagtgattgatgatattgccggaagtccacaccgatttagacttggaacagatacgtattatcataattctcaacaattatttttaccgttatcgatgcaaagacaactaatggatcgtgagtcagatgataaagtataccttgatattttcaatgatgtacttaagcaagtagatagttattttaatttgtatgatgtgaatggctttagagcagctctgcaaaagagtaaaaaagccttcgagcaattaccgattaatgattttcctaaagatgtgccagacaataaaaagaagaaaggaaagcgttcaattttaaaggagatttttattgggctacatgcgaatgcaacattaggcaacttaaaacaaatgggcattaaaacagattttggaaaattacaaaaaagtaacggtttacggattactgagaattgtaaaattatccatcagtcgccgactgggttgtttgaacgaatcgtaccgattaaataa

SEQ ID NO: 340 - DNA, 4161 bp, Lactobacillus parakefiri DSM 10551
atgtgcctgaaggagtttactgggcaacattattttgaggagttttatcgtatgaaagttaataattatcacataggtctcgatatcgggacatcgtcaattggttgggtcgcaatgggagaagacggcaagcctttacgcgttaaagggaagacggcgattggtgcccgactattccgagaaggcaacccagctgctgatcggcggatgttcagaacgactcgtcgccgtctgaacagacgaaagtggcggttgaaattattggatgaaatatttgatccatatatcacacctgtggacagtactttttttgcccgtttaaaacaatctaattggtcgcccaaagattcacgtaaggcattcaaagactcaacgctgttcccagatttaaccgacaaacagtaccacctcgattacccaaccatttatcacttacgtcatgcgctcatgactcaggataaacagttcgatattcggatggtgtatttggcacttcatcacattgtcaagtatcgtggaaatttcttaaattcaacaccggtggattccttcaaagcatcgaaagtgaattttgatgatcaatttaaaaagttaaatgagttatatacagcaataaatcctgaagaatctttccaaattaatttcgcaaatagtgaaaagatcggccaacaatttcttgacccatccattcgtaagtttgataagaaaaagcaaatttcaaaaattgtcccagttacaatggacgataaagccgtggacaaacttaacggcaagattgcttcagaaatcgtcaatgctattttaggatataaatccaagctggatgtggccgtgcagtgtgacccagaagattcaaaaccatgggcggtgaaatttgatgatgaagatattgatgccaaactgcagaagattttacctgaaatggatgaaaatcagcaatcgatcattgggatcattcaagacttgtattctcaagtaaccttaaaccaaattgtcccaaatggaatgtcattatcagaatcaatgattaaaaagtacaacgaccaccatgatcacttgaagttatacaaaaagttgattggtcagatttcagattccaagaagaaaacagcattgaagaaggcatatgatcaatatgttggcaacgatggtaaagtcatcgaacaagatgacttctattcgagtgtgaaaaagaatttggatgattcagagttatcaaaacaaatcatggatctgattgacgctgacaaattcatgccaaagcaacggacatctcaaaatggtgtcattcctcatcaactccaccaaagagaattggatgaaatcatcgaacaccaaagtaaatattatccttggctggcagaatctaaccctaacaagcatgatctgcacctggcaaaatacaaaatcgaagaactggtcgcctttagaatcccatactatgtcggtccaatgattactcctgaggatcagaaaaagtctggggccgcagtcttttcttggatgaaacgcaaggaaccaggtcaaattacgccttggaactttgaccagaaagttgatcgaatggaatcggccaataagttcatcaagcggatgaccacgaaggacacttatttaattggtgaagacgttcttccagacgaaagcttgctgtatgaaaagttcaaagtgcttaatgagttgaatatggtccgggtaaatggtgactcgttgaaggttgctgacaaacaggcgatttatcaagatctgtttgaaaattataagcacatctccgttaagaagatgcagaactacattaaagataaaactggattgccaaacaatcctgacatttctggtttatccgatcctgatcattttaataattcattaggaacttacaacgacttcaaaaagctcttcggcgataaagttgacgatcccgacctccaagatgattttgagaagatcgttgagtggtcaactgtctttgaagacaagaaaattctgcgggccaaactcaacgaaatttcatggttgtctgataagcaaaaggatgatcttgaatccagtcgttaccaaaggtggggccgactttccaagaaactcctgactgggattgtcaacgatcagggtgaacgaatcattgacgaactttggaacaccaacaagaacttcatgcagattcaatctgacgatgactttgctaaacgaatccatgaagccaacgccgatcagatgaaggcaactgatgtggaagacgtcttggcagatgcatacacttctccgcaaaacaagaaggccattcgacaagtcgttaaagtggttgatgacattcaaagagcaatgggtggtgttgcacctaagttcatctcaattgaatttacccgttcagaagaccggaatccgcggcggacaatctcacgtgaacgacagctcgaagataccttgaaagatactgctaagaccttggttaaatccatgaaccctgacattctatctgaattggataatgcttcgaagtctaagaagggtctgactgatcgcctgtatctttacttcactcagcttgggagggatatgtatacgggtaagccaattaatatcgatgaaatcagtaattatgatattgatcatattttgccacaggcgtttatcaaggatgattcattaagtaaccgggtgcttgtatcaaaggcagtgaacaatggtaagtcagctaatgttccactgaagctgtttggcgtcaaaatggctcacttctggaaacagcttgctgaagcgggattgatcaataaacgcaaactaaagaatcttcaaacgaatcctgataccattagtaagtttgccatgcacggttttattagacgacagttagtggaaaccagccaggtgatcaagcttgttgcaaatattcttggtgacaaatatcgcaatgatgataccaagattattgaaattacggctcggatgaaccatcagatgcgagatgagttcgcctttatcaagaaccgtgaaatcaatgattaccatcatgcctttgatgcttatctgaccgcattcttaggcagatatctatatcacagatatattaagctacgtccttacttcgtttatggtgacttcaagaaattcagagaagataaggttaccatgcgtaatttcaacttcctgcatgatttaacagatgatacccaggcgagaattgctgacaccgaaactggtgaggtaatttgggatcgcgaaacttcaattaagcagttgagggatgtttatcattataaatttatgctgatttctcaagaggtatacactctccgtggggcaatgtttaaccaaacaatctatccagcagacgaggccggacggaaaaagttgatcccaacgaaagcagataaggcggttgatgtatatggcggatacagtggtagcaacgatgcatatatggcgattgtccgaattcacgataagaagggtgataagtacaaggttgtcggcgtgccaatgcgggcgctggatcggctgaatgctgccaagaatgtgagtgatgccaaatacgaccaagtcctcaaagatgtcttgacgccacaatttacaaagtccaagaaaagtcggaaaactggggaaatcagtcaaacagttgaagactttgaagttgtcttgggtaaagtgatgtaccgccagcttgtgattgacggtgataagaagttcatgcttgggagttcaacttatcaatataatgccaagcagctggtcctgtctgatgaatccgttaagacccttgcaagcaaaggaaagctggatgaggcacaggagagtgctgcgtatgataacgtctatgatgagattttggataaggttgatcggtattttgcattgtatgatcaacgtaattatcggacgaacctacatgaaggggaacaaaagtttattggattaccactacatgatacttttgatggaagtaaaaaagtggccaacgggaagcgcgaaaccatctcggatattttaaatggcctgcatgcaaatgcaactatgactaatctgaaagttcttggtatatcctcaccgtttggaatgtttcaatcacatggtcctattaacttgaatcctgaaactataatcttatgtcaatcaccaactggattatttgaacgtcgtattattttaagagatctataa

SEQ ID NO: 341 - DNA, 4086 bp, Lactobacillus pentosus KCA1
atgaacgaaccgtatggtgtgggcttagatatcgggacgaattcggttggctggaccgtcgtcgatatgaacggacgtgttagaaaggtcaagggaaagacggctcttggggcacggttatttaaggagggtgcaactgccgaggatcgtcgtggctttcggacaacccgacgccgtttaaagcgggtaaagtggcggttgcgattgttacgtgaattttttgatcaaccaatcagtaaaatcgatcctaacttttttgcccgacgtaagtattcggatatctcgcctcgagacccgaactacaatggattagcaaaaacgctgttcaatgaccggaccgataaggaattttatgatgactatgccacaatttaccatttgcgagacaagctgatgacgagcaaccggaaatttgacattcgggaaatctacttggcaattcatcatattgtcaaataccgcggaaattttttgcgtaccggaccagccagtcaatatggtagtgcaagcttgcatttagcgactagcttccagaagcttaatgatctgtttgctcagtccgaggagacgttaaatcttaagttggtaactgatgaggcactgcttcaacaaatccagcagatcttagtacggacagacttgtcacgttcggaacagcaaagacaaatttggccactcatggcagttttgacgggagcgagcgctgctgaaaagaagcgtcaaaagaatgttgtcgttgaactgtcgaaggcgctggttggccttaaagcgaagatgaacgtggtgacattaacggaagtcgatgccgcagtagtaaaggattggacctttacgatggaggaaagccaagacaagcttccggaaattgaagaacaactaagcgaagttggacaacagattatggatgaagtgatccaactatatgctagcgtcaacctcgcgcaattgattccagcaggtaagcgtttttcacaacacatggttgagaaatataagcatcatgaaaagaatctagagctgttaaaagcttatattcactcacagtctgattcaaaacgtgggcgtgagattcgcgcaacctatgaccgatatatcgatggtgtcgatagcaaaccagttacgcaggaaatgttctacaaagatttaatgaaatacgttgaggctgatgctacatcgaatcatctggcagcagagattaaagatgaaattgactcggaacaattcatgccgaagttgcgtaccaagcagaatggctcaattccatatcaagtccaacaatatgaattagatcaaataattagtcatcagaaaaagtattatccatggcttggtgaagaaaatcccgttgctgaacggcgcggcaagttcccatataagttggatgaactagttggttttcgggtgccttactatgttggaccactcattacaaaagaggaccaacaagccacttctggcgctgggtttgcgtggatggtccgtaaagcagatggtccaatcacgccatggaattttgatcaaaaagttgatcggattgcttcagcaacggcgtttattcaacggatgcaaacaacggatacttacttgattggtgaggatgtcctcccagcacgtagcctgatttatcagcgcttcatggtgctcaatgaattgaataatatgcgagttgaggatcgaaaactggcgccgcaacaaaaacaacgtttgtataatcaagtgtttaagcaacatcaacatgttagcgtcaaaaatattcagcagaatttgatggatgccggtgagtatcgaaaaacgccccaaataacggggctcgctgaccctaaaggattcaatagctcgctatcaacgtatcatgatttcaaaaagattttgcttgaagcaatcgccgacgaacataagcgggctgatattgaaaaaattattttatggtcaacgacgtttgaagacagtgccatttttaagcagaagcttgaagaagtggcctggttgacggatgcccaacgtaagcagcttagtggactgcggtaccgtggttggggacagttgtcgcataaattactgaccgcctttaaggatgacaaagggcgttccatcatggatggcttgtgggagaccagcgataactttatgcagctgcgtaagcaacctgcaattgaaacgcagattaaagaggctaatcaagctaacctaactgatgcggatatccaagataccatcaacgaattgtacacgtcgccgcagaataaaaaagccattcgtgaagtgatgctggtactagacgatatcaagaacgcgatgcatgggcaaacaccaagttggattttcgttgaagcagcgcgtggcggtggcgttgcgggtcggcggacgcaatcacggtccagccaaattgtggaagcttacaaaggcacagccaaagagatcgttagcgaaaaagttcagcatgaattgaatgaaaaaattaaagccaaggctgattttaatacgcggcttgtgctctatttcttgcaaaatggccgcgacctgtacaccaatgaagccattaatattgaccggttatcagagtatgatatcgaccatattttaccgcaatcattagtcaaagatgactcgttagataaccgggtgctgactagtgcgcggattaatcgagagaaaaacgatacgtttgctagtgagaaattcggtcgtaagatgggcgcgcaatggcgagaattacatcggaatggcttaatgacacaacgcaaactcaagcacttgctgatgcgaccagatgagattagcaagcatgcgacggactttatcaatcggcaattggttgaaacacgtcaagtcatcaagctggtggaagaattaatcagttcggaatacccagcagcgtcaattgtggccgtcaaagccaatctaacgcaccaattccgacagacattcaactttccgaaacttcgtgaagtcaatgattatcatcatgcgtttgatgcgtccttaacagcgtttatcggaatgtatttattgaaacagtatccgaagttggaacgattcttcgtttatggcaagtttgctaagcagccgattaatttgacgcggttcaatattattcgcaagctggcagttgcggagaaaccaattgccaatatcgaaacaggtgaaattctgtgggataagacagccgatattaagtattttgaaaagctgtacaactacaagcgactactagtgacgcatgaggtgcgagagaattatggtgcgatgtttaagcaaacattgttcaaggcatcttataataaatcgaagacactggttccaaagaaaaatcatatggagacaagcgtatatgggggctattctaatcaagagacagcttatctggctattgttcgcattccgtttaaatcaggctttaaatttatagttgttggtattcctactcgaatggtagctaaaattaagcactatcagagcctgggtgcaactctcaatcaagccacacataaggtgattgagcccaagtttacgaaaatcagtcgtaaaactaagcagacggtgataagtgattatgaagtggtacttccaaaagtatacttggatcaagtcgttcgagatcaagtaaagggccaaatgtatcgtttctctctaggatcagataaggaatatcataatgtgcaagaattatatttgccattgtcgattcaacaggcatttgttggacactatgatgagtctgatgatcaacgttcaaacgatttagtaaaagtttatgatgcagcgttgaaacaactgcaacgatatttcccactgcatttgtcacgaaactttgaccaggtggcaagtcaagcacatcaaagttttgaggggctgaaaaacaatgtgcaaacaagtgataaacaattgggtaagaaagaggtgctcaatagtctatttgttggtttgcacgcaaatgcaacaaggtcaaacttgagtgtgctcgggatgagtaaagattttggacggataaaatcaaacggcattacattaaccgaccaagcagaaattatttatcaatctccaacaggattatttgagcggaaagtggcactaaaagatttgtag

SEQ ID NO: 342 - DNA, 4149 bp, Lactobacillus pentosus IG1
atgaagaaaatagttaattataacctcgggctagatatcgggactagctcaattgggtatgcggctattgatgatcaggggcgtccagtacggcatcaaaataagacggttatgggggtacgactttttaaagaaggcaagactgcagaaagcacgcgaatttttcgtggcactcggcgacgcttgagtcaccggcactggcggttaggttatttagatcgaatctttgacaatgagattgccaaagtggatgaaaattttttaccacgtctaaaagcgtcaaagcgtgctcggagtgatgaaaaacggtcatttagaggatcattgctatttccggaaaccggtgatgacgcctattatcaaaagtatccaactatttatcacttgcggtacgcgttaatcacccaaaagaaacaatttgatattcgactcatatatctggcgttacatcacatgattaagtatcgcggaaactttctggacacaacgcctgttagtgcattcaatattcacgatattgatctgactgatcagtttgcatcattaaatgattgttatcagttgcttgatatggattttgagtttcagtttgacctcaacaatattgagcaagttcagaagttgctgttagatgaaacactatctaaaacgaaacgtcaggcggctgtgtccaaggttctggttatgtcaacagggaacaaagcctttgatgatcagcaaaatgggattgctagcgagttcatcaaggcgttgttgggtggaccatttgacttatctaaaattttgaacttgtcagtcgctgacgtaaaaagttggaagcttcatatgaccgataaagatgttgatgacacgctcaatagcttggtagaagagcttgatgaaaatcataagcagattgtgaatttattgcagatgatctattcgcaagtaatgatgctagggctcctaaatggtcagcaatcaatatcagcatcgatgattgaaagatacgatgatcatgcaaagcactgggcagccttaaagaaattgctgcctgcattaggtgagcaagaacagtcgacgattattcacgcgtatacggcctacacagggcacagtcgcactaagcaactatctcgagctgaattttacacaaaggtgaactcaattcttaaaaagcatgaaaacattgcggaagccacaggtctcatagagctaattgaccgcaatgaatttatgccaaaacagcgtgatgcagtcaatggggtcattccacaccagctacatcaacgtgaattacaactaattattcaaaaccaacagaagtactatccgtttttagcggctaaagcttatccggatgctgatgaaacgatgattgagcagttgctttcatttcgtgtgccttactacgctggtccattagttgaccgggattttattaatgagtctagtgatcaagaacaggccatgcagaacacgaaattttcttggttaaagcgtcgtgaagctggcgaaataaccccatggaattttgagcagaaagtggatgttcaagagaccgccaaccggttcattaagcggctgacgactaaggatacttatttgatgacagaggatgttttgcccaaagagagcttaatataccaacgctttgaagtgctaaatgagcttaatgcgattcggattaatgatcgtcggttgacggcggaaaataaacaattagcttttcaacaattatttatggctggcaatactaaaaacgtttctatcaaaaagtttcgtaacttcgtgtttgatagtctaaaatttccggaaaaagtaaaaatcaccggctttgcaggtcagcataattttttggcaaaactatcaacttaccatgactttaagaaaatttttggtgaacgagtcgatcatactgatttacagcctgatttcgagcgaatcgttgagtggtgcacgatttttgaagaccggcatatctaccgagagaagctcaaggaaattcaatggttatcacagtcagagattgatcaattggttttgattcgtaatcatggatggggacggttatcaaagcggctgttgactggcatacgagattcagatgggagaacagtcatggatcaactttggtttggaactgataacttcatgcgtattatttctcaatcagattttgcggcagctattgcgaatgaaaatcgaactcaactgaatcagcatggcctggaagatgtactggattctgcctttatgtcacctcagaataaaaaggctattcgacaagtgctcaaagtagttgatgatattgagcagactttagggtgcccacctaagaaagttatgattgagtttacgcggagtccagacaagaagaagcaaagaaccgtgacgcgacttgaaaaagttcaacaggcgtacaaagcagttgctgatcaattggcggggcagtcgattgtgagcgaactagatcagtatgctaacacgcacagtaaactatccgatacttattatctgtacttcatgcagttgggacgcgatctatatagcggaaagccaatcgatattgattcgccgatgctggatgacgatcacattttaccgcgtgccttcatgaaggataactcgttggataaccgtgcattgacggaaaaaccaatcaacaacaccaaagcagccaaatttccatccaaagtgttcggacagcaaaaggaggttactgatttttggaagttactacgacgctgtggcttgatgagtaatatcaaagagaagcatttgtatttggaccctgacaacgtagataaatggacacgaaggggatttattcaccgacagttagttgaaacgagtcaggtaattaagattgttgcgaatatcttgaacgatcggtatcaacaaagtcaaacggaagtgttggaagtgcccgcacgattaggtacggaactgcgcgaatgttttggctggtataaagttcgggaggtcaatgactatcatcatgttttcgatgcctatttagcagcctttattggcaattatctttatcgtcgataccctaaactgcaaccttattttgtttatggtaattttgccgaattaaacaaggcacaacttaagaatatcaagagctttaacttcttgtataatattactgataataagcgtgttgtcaaagatattgagactggccaaaccctttgggatgatcagattcgccaacagattcagcatatttatgagtataagtatatgttgacttcccatgaagcattcacacagcataaggaattgtatggacaaactatctatcctagacgtgaattcaagcctggaacattgaaagctatcaagcaagatcagccccaggaattgtacggtgggtataaaaatttaacggctgcttatatgtgtatcgttaaaattcaagcgaggaaaagaagggcggctgagtatcgtgttgtgagggtcgcaactgagagtctatcagcgttacagcaagctaagcgtctaggggtgcaagcttacgagcggtgcttgcggcaagaattggttcgaaataatgaaatcttgcggacgaatgcggatccaaacagtgcacctcgcgaatttgaagtgttgttggatcgcgtcttgtgccatcaaatgattatcagtgatgggcagaagtatctgctaggcagccatgcttataagataaattgcatgcaattggttttgtcaaataattcgatgaagatactgagcacaagcattgtgaaattgaaacaaatgactaatgaaccactagtacaggtttatcgcgaaattttggatgtcgttaataagtattttaccttgtatgatgttaacagcttccgtgagaatttaaatcagttttttgataagttcaggacattgcccataacgaatgagtatgagtctagtaagtctggaaaaaaactgatccaccgtggacaactagaaacgttaaccttaatcttaagggggctgcatgctaatagtgataaggttcaatatggagatcaatctaccctgcttggaggatttcaaactaaagacggaattaagctatctaaagatagtgtgattcagtatacgtcgccagccggattgaatgtgcgaactgtgaaattacgtgatttggagcaaaaggaggctcaaaaatag

SEQ ID NO: 343 - DNA, 4077 bp, Lactobacillus plantarum EGD-AQ4
atgaaagaaccatacggtgtaggcttggatattggtacgaactcggttggctggacggttgtggatgcaagtggtcatgtcagaaaaattaaggggcagactgggattggtgtacggttatttaaagaaggggcagccgcagcagaccggcggggatttcgaacaacgcgtcgtcggttgaaacgggtgaaatggcggttacgattactacgcgaattctttgaccaaccaatcagcaaggtggatatcaatttctttgcgcggcgcaaatattcggatgtttcacctcgtgatcctaattataacggtcttgaaaaaacgttgtttaatgatcggagtgatcaggatttctatcatgattatccaacgatttatcatttacgtgaggcgctgatgactcagcaccgcaagtttgatgtgcgtgaaatttacctagcgattcaccatattgtcaaatatcgcggcaattttttgcgtaatgatgcagcgacagcgtatcgaagtgggacacttgatttacagcagcactttgaaactttgaatcatttgtttagtcaggctgatctggagctgaacttgaacctgacaaccgatgtagcgttgcttgacagcatcaaacaaacattggtacgaactgatatctcgcgtagtgaccgccaaaaattaattatgccactattagcagttttaactggcgcgactactgcggaaaagaagcgccaaaaggcagtggtaacagaatttgcgaaagccctcgttggaaataaaaccaagattgatgtgctgactctaacggacatcgacgctactgaagcaaaggattgggcctttagtttagaggaaaatcaagacaaacttcctggcattgaagaccgttttagcgaagtgggccaacaaattattgatgaggtaattcggttatacgccagcgtcaaccttgcacagcttattccagaaggtaaacggttctcacagagtatggttgagaagtataaacgccatggcgaagatttgaagttattgaaagcgtatattcgctctcagtcagacgccaagcgcggacgggctattcgggcaacctacgatcaatatattgatggtgtgaaaagtaaacaggtgacgcaagaagcgtttcaaaaggccttgggaaaatttgttgacgccgatgtagatttgaatagttgggcagctcaaattaagcaagctattgactctgaacaattcatgcctaaattgcggacaaagcagaatggagctattccttatcaggttcaacaaaatgagctagatcaaattattagtaatcagaaggaatactacccgtggttgggtgaagaaaatccggtcatcaagcgacgcggtaagtttccatacaaacttgatgagcttttcggtttccgggtgccttattatgttggaccgctgattactaaagaaatgcaggcagcaactgccaatgcaggttttgcatggatggtacgtaaggctgatgggccaatcacgccatggaattttgatgataaggtcgatcgggtggcctcggcgaccgctttcattcagcggatgcagacgacggatacgtatttgatcggtgaggaagtgctacccgcacgcagcttgatttaccaacgctttatggtgctcaatgagctgaataatattcgagttgatgatgggcaattaacaccccggcaaaaacaacgactatataaccaagtgtttaaaaaacacaaacgagtaacagctaagaatattcaagacaatttagttgcagcgagagagtttcccactgcgccacgaattacggggcttgcggatccgaaagtattcaatagttcgttatccacgtatcatgatttgaaacaggtgttgcctgaagctatgtcagacgtgcgtaagcaagctgatattgaaaaaatcattttatggtcaactatttttgaagatagtacgatttttaagcaaaaactgacagagatttcctggctgacagcggcccaacttaagcaactaggtcaattacgatatcgtggctggggacaattattacgaaaattattaacaggtctcaaagatgataataatcgttcaatcatggacggcttgtgggagacaaacgctaatttcatgcaattacgaagccaacctgccattgagaatcaaattaaatcggcaaaccaggccaacctaacaacggcggatcttcaagataccatcaatgaattatatacgtcaccgcaaaataagaaggctattcgcgaagtgatggtggtgttagctgacattaaagatgcgatgcatggtcaaacacctaactggatatttgtggaagcggctcgtggtggtggcgttgctggtcggcggacacaatcacggtcaaaacaaattgttgcagcctatcagggaacagctcaggccattgtcagggatcaagtccaacgtgaattaaaagagaaaatcaagaacaaagctaatttcaatacgcggctcgtactttatttcctacaaaatggccgcgatttgtataccggtgatgcgattaatatcgatcgattgtcagaatatgatatcgaccacatcttgccacaatctctggtgaaagatgactcattagataatcgagtactgacaaatgcacgcatcaatcgtgagaaaaatgatacgtttgctagtgaaaagtttgggaaaaagatgggtgctaagtggaaagagatgcaccgaatggggctgatgaccaaacggaagcttgaccacttactgatgcgtcctgatgaaatcagcaagtacgcgactggttttattaatcggcagttggttgagacacgtcaggttatcaaactagttgaagagctgattaatgcagaatatccatccaccgctattgtgtcggttaaagcgaacttgacacatcaatttcgacaaacgtttgattttccgaagattcgtgaggtcaatgactaccatcatgcatttgacgcagccttaactgctttcattggcacctatttgttgaagcgatatccgaagctggaacgattcttcgtctacggtaagttcgctaaacagccggttaacctaacacgtttcaatgttatccgaaaactagctaagactgataccccaattacggatatcgatactggtgaagttttgtgggataagttaaccgatattaaatattttgagacgctttatgattacaagcgattattggtgacgcgtgaggtatccgaaaactatggggcaatgtttgatcaaactctcttgaaggcaagtgataatggcaagcgattaattcggaaaaaacaatccttcgatacagctatttatggtggttatacgggaaaaacgctggcttacatggctatcgtgaaagtatcgactaaaaaggatgtccagtaccaagttgtaggtgtacctacaactatggtgacacaaattgagcagttggaacaacaaggaatgacaaacaagcaagcggtgacgaaagtaattgaaccgctcattgctgccaacaacaagaagatgctgacgtatgaagtgttattgccgaaggtacggtttgaacaggtggttcgagatagaattaaaggtcaaacgcaccgcttcgcacttggtactgatacgtattatcacaacattcaagagctgtatttaccattaactttacagcgcgcatttttaggtaagcagaatgagtctgaagtgcaattaaatcagaatttactgactgtttttgacgcaacgcttgcccaggttaaccgatactttccactttacgagatgaacaagttcaagaagatacttaattctgctcgtgatcagattgagctgctggaagcgaaaaatcaatttgttaagaataagctggttttagggaagcaaggaattttgaccaatatgtttattggcttacatgcgaatgcctcgtatggtgatttaaaggtgctaggtgtgaaaatagattttggtaagttacaggttcctggtggcattaagttaacgggtgacgctgaaattatatatcaatcaccaactggtttgttcgagcgaaaaattgcattaaaagatttatag

SEQ ID NO: 344 - DNA, 4173 bp, Lactobacillus psittaci DSM 15354
atgaaagaagtaaaagactatattattggtctcgatatcgggacaaattcatgtgggtacgttgtaacagataaacaaaataatattttaaagcttaaaggtaaaactgctattggagcacgcctttttaaagaaggcgaagctgcagctgatagacgtgcctttagaactactagaagaagattggcaagacgtcgctggagactaggcttacttgaagaaatctttgatgaggaaatggccaaagttgattcaagtttctttagaagattaaaagagtcagattattctcctaaagatagccgtaaacaatttaattcaattgtttttgaaagtagtgaagcagataaggatttttacgataaatatccaactatttatcacttacgtaatgctttgatgcatgatgatcaaaaacatgatttacgagaaattttcttagcagttcatcatattgttaaatatcgtgggaactttttacgagaagattctgttaaggcttttaaagcagctaaattcactttacaaggtgaagatggaataggtccagttgataagttaaatgatttgttaaaagaaatttatattgaagctgctcctgaacttgcaaccgacaatctatctaagattgaagagattatcaaagataagaagttatacaagcaagataagttaaaacaagttgcaactttattaactaaagaagcagatacaaaggacaaagcaaagcttaataaagatgttgctaagcaagtagccaatgcctttatgggctacatgattatatttgatactatttttaacttaagtgatgtagatagcaaagattataaagttaaatttagtgatgcaaatattgatgaaaaattagatactctaactagtttattgactgataagcaaactgaatttgttttagaattacaaaatatctacaataccatcgtcttaaatgaaattgttccggatggtaaaagtttgtctgaatcaatggtcaagaaatatgatgaccataaggaagacttgaagttatttaaagcttatcttaactcattaactgatgttaagaaggtaaaagaacttaaagctgcatatgtattatatgtgaataatcgtaaagctaatttattagcagctaagaagttattaggcaaaaaagctgataatatgaataacttcgaaattttcagtaaatttgttgctgataatttagatgattcagaattagcaaacaaaattagagctagacttgatttaggtgaatttttaccaaagcaaagaactaatcaaaatggggtaattccataccaattgcatcaagttgaattaactcaaatccttgaaaaacaaggtaaatattatccattcttgatagcacctaaccctgttgaaagtcatagaaataatgcaccttataggattagtgaacttgtatcattccgtgtgccttattatgttggaccattaattgatccaaataatgctgaatctgaacaagataaggcaaatagttcctttgcttggatggtacgacaaaagcaaggtcaaattacgccttggaactttgaagaaatggttgatacaactgaatcagctaataagtttattaagcgaatgacaaccaaggatacttacttattgggtgaagatgtattgccagcttcaagtttgatttatcaaaaattcgttatcttaaatgaattaaataatattaaggttaatgggattaagttaacgtctgaagagaaacaccaaatttttgatgaactctttaaggtacaaaaatctgttagcttaaagaacttggttaacttcttgactgctcatggttgtgttgctcctaatgtaactggcttgtctgatggaactaagtttaatagtagctattcaacttatattgactatcgtaagatttttggtgctgaaattgataataaagataagcaagcagactttgaaaagatgattgaatggtcaacggtgtttgaagaccggaagattttcaagcgaaagttagaagaaattacttggctaacacctgaccaaattaaacaagtaagtagtaagcgttactcaggatggggaaggttatcaaagaagttattaactcaaattacagatgaaaatggagttaatatcttgcaaagactctggaatgaatctgaaaacttgatgcaaatattatctgatcctgtaattaaagaaaagattgtagctgctaatagttcatttaccaaagctactgacatggaggatatcttggcagaagcatatacttcacctcaaaataaaaaagccattcgccaggtaatgcgagtggttgatgatatcattgctgcagctcatggtaagaaacctagtcaaattgcaatcgaatttgctcgtgaagaccaagataatccccaaatgactaagtcacgtaaggcacaacttgaccaaatttatgccaaaattagtgatgagttcttggataatgctgttaaaaatgaactaaagaatatgaaagataataagcctctggctaaggacaaagtattcttatacttcaaacagatgggtagggatgcttatactggtgaaaaattatctttagataacttgcaagattatgatatcgaccatatctatccgcaatcctttattaaggatgactcatttgataacagagtacttgttcaaagagctgttaataatggtaagtcagataatgtaccagtactcttatttggtaataagcaagctgcagatttaggcatgactattcgccaaatgtggaagaagtggctagaactaggacttattagtaaacgtaagtttaataacttaattactgatccagaaaagatttctagttatatggcttctggatttgtaaatcgtcaacttgttgaaactagtcaagttattaagttagttgcaaatatcttacaagctaagttacctgatactgaaattattgaagtaaaggctagctacaattcaatcttacgtaaggaatttaacttatataagagtcgtgaagttaatgactaccaccatgcaattgatgcttacttaactacaattgtcggtaattacttatatcaagtctatccaaaacttagaccatactttgtatatggacaatttaagaagtttggtaaggctgaaagtaaagaagatgatccagttaagaaaattaagcaattcaactttatttatcaactactctggggcaaagatgacgcaatctgcattagccatactgatcaacaagtatttagtagaagcgatattattaacaaattaactacagcatataatttcaagtatatgaatgtatcacaagaagtttataccaatagtaataatgtgtttaagcagactgtcttcccaattattgaacgcgatactgctaagagtagaagcttaattcctaagaagcttgatcgaccaactgatatttatggtggatatagcaataataatgatgcttacctagctttagttaaagtagataagaagaaaggttcagaataccgtgttgttggtattcctatgagagctgctgcgatgcttaaagcttcaaagaattatgatgaagacttacgcaaagttattgaaccaatggtaatgcttgataagaatggtaaagctaagcgcggaattgaaggattcagagttttagttggtaagatgccgtttaagcaagctgtgcttgatggtgataagaagtttatgctaacaggaactaacgatatgccaaaccttaaacaattagtactgtcacagcaaaatatgaaatatatacttgattatattgatgatattgattgtagaaaacataaatttggtaataaaactcaagatggaaataaatgtttactagaagtatttgatgaaattatacagattgttgataagcattttgaactttttgataatagaagctttagagaaaaattacgtaatagtagagtaaattttatcaacctagcattatctaaaaaagctgaagcgttgttggcaatacttaatggattacatgcgaattcaatgagaacaacaattaaagaattaaaaatttcagatttaggaagaattcaatcgtctgtaatttctccagaagcacaacttatctaccaatcaccaactggattatttgaaagacgagttaaggtaaaagacttataa

SEQ ID NO: 345 - DNA, 4110 bp, Lactobacillus rennini DSM 20253
atggataagccctataatatcggccttgatatcggtagtcattcaattggctggaccgtggtcgatgataacagtaaactggttagaattaaaggtaaattaggttatggcgtgcgcctctttgatgaaggcaaaacagccgaagaaagacgccaattcagaacaacacggcgccgtttaaaacggcgtaaatggcgtttaagattactgcgtgaaatttttgaacctcatatagcaccactggacgaaacatttttccttcgccagaaacaatctaatctagttcccacccaaaaaaagctaccgcaactaagtttatttaacgatcggtcagatgctgaattttaccacaagtatcctaccatttatcatttaagaaacgctttaatgaccgaaaagcggcaatttgatttacgcgaaatttatctggcaatccaccacattgtgaaataccgcggtcattttctaaatgcggcccctgcggcatcttttaaaagtggcaaatttgatttagaaaataagtttgatcagcttaatttgctttttgcgagcgcttatagtgatttagatttcactttaaggactgacaacgttgatcaagttaaagcaatcttactcaacgaagatctcagtgccagtacacggcagcgccaagcattaccactgatttatcaaacatcagctgatcaaaaagcagcaaaaaagctaactaaatcacttgccactgaattattaaaagccattttaggtttaaaagctaaatttgacgtcttaacaggaattgagaccgatgacactaaagcttggcgtttgaccttcaacgctgaagattttgacgataaattaaacgagttaaacgtcaccgacaatgaagcagcaacgcaaatcatcgaaattttacgcgaactttattccagcattttattagctgccattgtgccggaaaattacacgttatcccaagcaatgatggcgaaatacaacgcacacaaacagcacttatcattattgcgacaggttaaaacaaccttgccagcaaaaaagcaaaaagagttgcaagcagcctatgatgactacattgaccagcaccttcccctagataaattctacgcaaaattaactaaagttttaccaaaagaaaaagacactgataatccgcaaattattcaaatattgaatttgattgacttggatcaatttctaccaaaacaacggactaaagacaacggtgcaattcctcatcaattgcaccagcaagaactcgatcaaatcattgacaatcaaaaagcctactatccttggttagcccaattaaatccaaatgaaaaacgccaaaagatagccaagtataaattagatgaattggttgcattcagagtcccttattacgttggccccttaattgaagccaaaacgcaacaaaaaacttccggtgccaactttgcttggatgatccgcaaagaacctggtaccactacccccattaccccttggaactttgatgaaaaagtgaaccgacaagcttcagccaatgaatttatcaaacggatgaccaccacggatacttatctgctaggtgaagatgttttacctaaacatagtctactatatcaacggtttgaagttttaaacgaacttaatggcattaaaatcgatcaaaaacgcgtgactgtacggcaaaaacaagcgattttcaatgatttatttttaaagcaacctaacgttacggttaaaaaattgcagcaatatttacaagctaaaggcgaatacgccagtgcaccaatcatcaccggtttatctgatcctaaaaaattcaacagccaattaagtacttaccatgagtacaaaaaaatttttggcggattaattgacgatcctgataaacaagctgactttgaaaaatgcattgaatggtccaccatttttgaagacagtcaaatccttaaagataaactaaaagaaattaactggctaacccctgaacaacggcacaaagttgccaataaacgttatcaaggctggggtcgactatctaaaaaattattaacacaattggtcgattacaatggtcagcggattatcgatattctttggaatacaactgataattttatgcaaattgtccactcagaggcgtttgataaagcaattatcaaagaaaatcaagctttattgacgcaatacaatccgcaagctgtaattgatgatctgtacacatcaccgcaaaacaaaaaagccttgcgccagattttattagtggttaacgatattcaaaaagcactaaaaggccaagcgccaagtcggattttaattgaatttgcccgagaaggtcaggaaaatccacgcctgtcaacgcaacggaaacaacaagttgaaaacgcgtataaagaagcaagtgatgccttgctcagcagtgcagaagtcagacaagaactcaagggcttagacaataaagctctcgcgaacacccggctcttcctttactttatgcaaggcggccgtgatatttacacaggcaagagcctaaatatcgatgatttatccaaatatgatatcgaccacattttgccgcaagcattcattaaagacaattccttagataaccgcgtgctagtttctgctaaaatgaaccggagtaaatctgatcaagtcccattaaacgactttgcggagattcgctatgggaaacaaatgcggcaacaatgggaaaaaatgctacgggcaggcttaattacgcggaaaaaataccataatttaacactaaatcctgaaagcattaataaatatactgctaaaggtttcatcaaccggcaattagttgaaaccagacaggtgactaaattagccacaaaccttttagtagatcagtatgctgaagacgatgtccaactaattaccgtcaaaagtaatttaacccaccaaatgcgggaagaatttgactttcctaaaaaccggaacgtcaataaccatcaccatgccttcgacgcttacttaactgcttttgtcggactttatttgctaaaacgttatccaaaattagccccttactttgtttatggtgactaccaaaaaggtgccagtcaaaattcaaagtggcgcaattttaactttttaggcaacttacaccgagagaaagtggttgataaaaataccggtgaaattatctggcaacgtgatgctgggttaggtgaactaaatcggatttataactttaaaaagattttggtgacccgcgcactacgcgttaaccgcggtccaatgtttaaacaaaccatctataaggcagaggaagataagtccagcggtcgtggcagtaaacaactaatcccaaccaagaaaaaccggcccactgagttatatggtggctacacgaacaaagaaactgcctacctctgtttagttaaagaaccacacaaaaaaggcgacatttatcgaatttgtagcgttttaaatatgtggctcacagaactagatcggattgctgacccaatcgctaaagcacaaaaattaacagaattattgaccccccaattcacaactaccaaaaagaagcaaggacagaaaattccagtcgttaaaccgtttaaggttgtcattcctaaaattttaattaatcaacgcttctttagtcgtggtcaagaattaaccgttgcttctcccatgtatatgcataatgagcaagaactctttctcaataaaaaaacaattaaattattaaacggtcaattagctaaaaacgaggctcacgagttagcacctaaaatttatcaacaaattttagatcaagtaaatgattattttccactttatgatatgtataaattccgtgacacccttaacgcaagtaaagaaatttttgttaatttaccttggcaagaccaacggcaggacaaaaaaattagccaatctggtcagaaatctatcttaaataaaattctaattggattacatgctaatgctgctcgaattaaattaactgaattaaatttcaaaagtgatttcggtctcttatcacaaagatctggtattgccttctcacctgatgatcaaattatttatcaatcccctactggtttattcgaaagaagggttacgttaaaagatttataa

SEQ ID NO: 346 - DNA, 4086 bp, Lactobacillus rhamnosus GG
atgacaaaattgaaccagccatatgggattgggcttgacattggttccaattcgattggctttgcggttgtggatgcgaatagtcatctcttgcggctgaaaggagaaacagccatcggtgcacggctatttagagaggggcaatcagctgctgaacggcgggaaagtcggacgactcggcggcgtttgagtcgaactcggtggcgcttaagctttttacgcgatttctttgccccgcacattacaaaaattgacccggatttcttcttgcggcaaaagtattccgaaatttcgcccaaagacaaggacaggtttaagtatgaaaagcgtctgtttaatgatcgaacggatgctgaattttacgaggactatccgagtatgtatcacttgcgtctgcatttgatgacgcatacgcataaagccgatccgcgtgagattttcttggcaatccatcatattttgaaaagtcgcgggcattttttgacgcccggtgctgctaaagactttaatacggataaagtcgatttagaagatatttttcctgccttgacagaggcatatgcgcaagtttatcccgatcttgagttaacttttgatttggcaaaggctgatgacttcaaggcaaaattgctagatgaacaagcgacgccgagcgatacccagaaggccttggtgaacttgttattaagcagtgatggtgagaaagaaatcgtcaagaaacgcaaacaagtgctgacagagtttgccaaagcgatcacagggctaaaaaccaagttcaatcttgctttaggtacagaagtagatgaagctgatgcgtcaaattggcaattctcgatggggcagctggacgacaagtggagtaacatcgaaacttccatgaccgatcaaggaacggaaatatttgaacaaattcaagaactttatcgagcacgattgctaaatggcattgtgccagcggggatgagcttatcccaggcaaaagttgctgactatgggcaacataaagaagatcttgagctgtttaaaacctacctcaagaaactaaatgatcacgaattagctaaaacaattcgaggtctttatgatcgatatattaatggcgatgatgctaagccttttttgagggaagactttgttaaagccttaaccaaagaagtaaccgcacacccaaatgaagtgtcggagcagctgttgaatcgaatgggacaggcaaacttcatgctcaaacaacgaactaaggccaatggtgcgattcctgtccaactgcaacaacgtgaactagaccagattattgctaatcaatccaaatactacgactggcttgccaaaccgaatccggtagagaagcatcgcgctagcaaaccttatcagctagatgaactgttaactttccgaatcccttactatgtaggaccactgatcacgccaaaagaacaggccgagtcaagagaaaatgtctttgcatggatgatccgtaaagatccttcaggcaatattaccccttacaattttgatgaaaaagtcgactgtccagcttcggcaaacatgtttatccaacgcatgaaaaacaccgatacttatttgattggcgaagatgtcttacctaaacgaagcctgttatatcaaaagtatgaagttttgaatgagttaaacaacgtcagcattgatggtaggaggcttggcgcagatcaaaaacaacgcttgatccgcgaagtgttcgagcgacatagcagcgtgaccattaaacaagtcgccgaaaatctagttgctcatggagattttgccaaacgcccagagattcgtgggctggcagatgagaaacgcttcttaagttcgctttcaacctatcatcaattgaaaaagatcttacatgaggcaattgatgatccgaccaaagagcatgatatcgaaaatattattacgtggtcgacagtttttgaagatgccgcaattttcaagaccgagctggctaaaattagttggttggattcagatacaatcaaggcattaagcaacatccgttatcgtggctggggtcagttctcgcgcaagcttttagatgggttgaaactaggcaatggccacaccgtaattcaggaattaatgctttcgaatcataacttaatgcaaattttgaccgatgaaacgttgaaaacaacgatggcggaattaaatcaagacaaactgaaggcagacgacattgaagatgtcattaatgatgcatatacttcgccaagcaataaaaaagctttgcgtcaagtgttacgggttgttgaagacatcaagcatgcagcaaacggtcaagatccaagttggctttatattgaaacggcagacggaccaggcactgccggtaaacgcacccagtcacggcaaaagcaaattcaaacagtttacgctaatgctgcccaagagctgattgatagtgctgttcgtggtgaattggaggataaaattgctgacaaggccagctttaccgatcggctagttctttacttcatgcaaggcgggcgggatatttataccggcgcaccgctgaatatcgatcaactcagccattatgacatcgatcacatactgccacaatcgttgatcaaggatgactctttagataaccgtgtgctcgttaacgccaccattaaccgcgaaaagaacaatgtatttgcttcaactttgtttgcaagcaagatggcagcaacttggcgtaagtggcacgaagccggtctaatcagtgggcgtaaactcagaaacttgatgctgcgtcctgatgagatcgataagtttgcgcacggatttgtcgcgcgtcaattggttgagacacgtcagatcattaaattaaccgaacagattgccgcggcgcaatatcccaacaccaagatcatcgcggtcaaagctggcttatcacatcaactgcgcgaagaactagactttccaaagaatcgtgatgtgaaccactaccaccacgcatttgatgccttcttagcagcgcggatcggcacgtatctgcttaagcggtatccgaaattggcgccatttttcacgtatggcgaatttgcaaaggtcgatgttaagaagttccgcgaattcaacttcattggtgcactaacacatgctaagaagaatattgtcgctaaagataccggcgagattgtttgggataaagaacgtgatatccaagagttggatcggatatataacttcaagaggatgttgataacgcacgaggtttactttgaaacagctgatttgttcaagcagacaatttatgctgccaaggattcgaaagaacgtggcggaagtaagcagctgattcctaagaagcagggttatccgactcaggtttatgggggttatacacgggaaaatacggcttatttggcggtggttaaaactgttgaaaagaaagcagatgtctatagagttgtcagaattgcaacttctcaagtagcggcattgaaagaagctagagcgcaatcgactgtcaaagaacgagaattattaaagaagtttttgacaacaaaattcacaaaaatcgggaagaacggtaaaaaagcaataacgccatttgatatcgttattccacgagtaccacgcgaacaactctttcataataaacgttatggctttttcatggttaattccgatacgctgatgcataactatcaggaactgtggatgtcacgctccgatcagcaaattttgtcaaaacttgtaaagtctgcgaaaactgtggaaaatggccaagtcggcaggctgtttgaaaatatagtggaacagattaataagtattttcctctgtatgatattaatcaattccgaaaaaagcttgatcaaagcaaagatatattttcaaaattaccattggaaggaaatggtacaacctcagggaagagagaaaccattcagaatattctaactggagcaggaactggtgcaaagaatggtgacttgaagaacttgggcataaaaacaccttttggttttttgcaagttccaagtggtattgtgctggatgacgacaccacattgatttatcaatctccaacaggaatgcttaacagaattgttcgattaagcgaactataa

SEQ ID NO: 347 - DNA, 4137 bp, Lactobacillus rossiae DSM 15814
atgaaaacgtttgcggaggaatacgtgatggataaatcaaaaccatatggaattggcctagatattggtacaaattctgtcgggttcgtggcgactgatgctgaggggcaccttatccgattgaaaggaaagacggttattggagcgtacctgtttaatgctggaatatcggcagcggaaagacgggggtttcggacgacaagacgtcgattatcgcgggttaaatggcgcctaggacttcttagagaaatatttgagactcattttcaggaaagtatgggagaaaatgaggataatgatttctttttacgtttcaaatactcgaatatttcacctaaagacccacaattttcgacggctaagggtttatttaatgatcgaacggataaggaattttatgatcagtatccgactatttatcatttgcgtcgggctttgatgactgaagaccatcagtttgatattcgggaaatatacatcgcaatgcatcacattgtgaaatatcgtggtcattttttaaaagaaggacgcgccaaagactttaaagttggggatttaagactgctggataatttcaaaatgatgaatgaacaaattgaagaaattaatcctttgtggcagttgaaattaccaactgatgacgcctctattaagtcgataaccgctattttactagacaatactcagagccaaaatgatcgtcaaaaagcagtgacgaaagtaattctggcaacacttgttaaggcgagtgacaaagacattaacgctgcacgtaaacggtttgttggcgaattgagtaaggctatggttggccttaaaacaaaactttgggttcttgcagatgtttcgcagaatggtgattgggaaattaagtatgaaaactacgctgactttgcggaaacgatcggttccggtgaaagtgacaccattcaaagtctttttaacgagattaatgatctatatggggttattacgttggctggcattattcccaaagaagctgagtcattttctgacggaatggtccgcaagtatgaacatcatcgtaaaaatctagaactgttaaaagtttattgtgcggaacaatcagatggtaaacggggacgacagattcgtcagacttatgataaatatattgatggggtagatagcaaacagtttacgcaggaagacttttataaggcattaagcaagttcactgcgaaggatgaagcgactagtgaaaatgccaaattaattgctcaggaaattgcagttggaactttcatgcctaagctgcgaacaaaggctaatggcaccattccacatcagttgcaccaaaaagaattggatgcaattattgaaaatcaaaaaaagtattacccatggcttggtgaagtcaatcccgttgagagtcatcgtcgcgcattgccatacaaattggatgaattagtcagttttaggattccatattatgttggaccaatggttacgccaacaaagggagatccagaaaaaagtaaatttgcctggatggttcgaaaggaaccgggtaccattacgccatggaatttcgatcaaaaagtagaccgatcggcgtctggtgaagcgtttattcaacgaatgaaaacgactgatacatttttaattggcgaagatgtattgccacaacaaagtctgctgtatcagaaatttgaagtactaaatgaattaaacaaaattatgataaacggtaagccaatttgcagagaacagaaacaacggcttttcaaacaactgtttatgcaatataagactgtgacagtgaagaaagttcaacaaaatttaattgcgaatggtgaagagtctgaaaatgtgccaattactggcttgtcagatcctttacggtttaatagttcattcagcacttatatcgattacaaagatattttgggtacagctgctgttaacgataatgcaaagcaaagcgatattgagcagataattgcatggtccacaatttttgaagatgcagccattttccgagagaagttaaatgatattacttggcttaatgacgatcaacgcaataagctcagtcataaacgttatcgcggttggggtcgtcattctcgcaaattgttagctggtcttcgtgacggagaaggccagactatcatcgaacggctatggaacacaaatgacaacttcatgcagattcaaaacgatagtgaaatagcgcgtcaaattaccgaagcaaactcaagcaagatggcaaccgctgagggaacagacgaaattatcgatggcttctacacttcacccgaaaacaaaaaggccctgcgtgaagtaatgaaagttgtgaaggatattcaacgtgcgcatcatggtcaggcacctgcttgggtttatattgaaagtccgcgagagacaccaagacccggtcagcggacagttagtcgagaacaacagttaacagatttgtatgagggtgcagcaaaagaaatcgttgatgatgccgttttaaatgaactaaaggacaaggttaaatccaaggaaaactttacggataaattagttttgtatttcttgcaaaatggacatgatatttatgcgaatgacagtatcaacattgataaccttaatgcatatgatatcgatcatgttttaccgcaaagtttgataaaagatgatagcctagacaatcgggttctcacaacacatgaaagaaatcttaaaaaatctaatcggtttgctacagaactgtttgccgatcaaaggaaaaaatgggaaaaatggcatcgattaggattgatttcgtcacgtaaattaaaacatttaactatgcagcccaattcagtagaaaaatttgcacatggatttattgcacgtcaactcactgaaacgaggcaaataattcatttaacggcgaatgtactttcaaatttatatcaagaaaatgacactaaaatcgttatgattaaggcgggattaaactcggagtttaggcgtacatttgattttccaaagaatcgtagtgtaaatgattaccaccatgcctttgatgcatttttaacggccaaaattggacgttacttattagcgagatatccaaaattagaacccttttttgtttatggaaacttcgttaagaatcctaaagcaatgaagcgattgagtagttttgatttcattgctcagttagctgctaaaactgatgatactagtcatatagatcaacgcagtttaaaacaagttcccgttgttaatgaagaaacaggggaaattgtttgggataaggatattgagcttgctgaactggacaagacgtataactacaaaactatgttagtgaaacgtgctcagactgaaaataatgctcaaatgttcaaacaaacagtttttaaggctcgtgacaatcaaaataaaacgctaattcctgtcaaaaatggattatctactgacgtttatggtggtcattcacaacaggcgatttcttacttatgtatcgtttgggttggacaaaagaaaaaatatcgcgttttgggaattagtaccgcccatgcaggcatattgaacaatttcgaaaaaaactacggccggtttgaagcgaaaaagaaactacaagaaattgtctccaatacactagataatgcggacagaaacgattttaagatagttgctcctaaagttttgtttgaacaagtggttgaggacgataacatgaagtttgggttgggtagtgctagtgactatagaaatgttcaacagttgtttttatcccggaaaaatcagttgctattggctaatatgatgactgaccaaatacacgaccaagatttagtccacctttttgacgaaatagttggtcaaatgaatgcgcattttcccatttttgatcgcggaggctatcgaagttcattgacccaatctcgtgataaatttttgaaattaccttttaaaaagaatgaggatttgatcacgaaacaagaggttattcgaagaattttagatggattacatgctaatgcaaatcgtaaagatcttaaaatcattggtagtaaaggtgattttgggagattgggaacaaagaaaatctacttatcgaaagatgcgaagcttatttacacctcaccaacatgtctttttactcgtactgttccactcagttctttgtaa

SEQ ID NO: 348 - DNA, 4128 bp, Lactobacillus ruminis ATCC 25644
atgagaaaaaaccaagaaccgtacaacataggcttggatattggcactagctccattggatggtcaataatgaatgataattttgatctgatgagagtcaagggcaaaaaaggtatcggggtacgattgtataacgaaggacagtctgctgctgaaagaagaatgcatcggactgccagacgtcgatatggacgaagaaaatggcgtctaaggttgttggaagatttttttgatgaacatatggccgaagtagacgacactttttttgcaagacttaaagattccaacatatctccaaaggatgataaaaaatatcggaaatcattgctttttccaaagtcaaaaggcgtcacgtaccaagatgatggcgagttttacaaaaaatatccgacaatgtaccatctgcgctatgcactgatgactgagcatcgaaaatttgatcttagggaaatatacttggcgtttcaccatatggtcaaatatcgcggtaatttcttatatgataccagcgttgattcttttgaagcaaagaaccttgatattaagggaaaatttgatgagattaatgatttgctctcgagttatacggatttttacgttgataacagcaatgcagcgctagttgaatcaattttgttggaaaaaaatacgaccagaaaagataagtcaaaaaagattgccaaacttcttcacgtagaagacaaagaaaagggcaagaataaaaaggccaaagatttggcaactcaaatctctaatgctgttttgggtttgaaatgcaattttcatctgatttttgaattgcaacagaagtattcttttgatttgtgttcggaaaaaacggaagaaaatatcgcaaaattgtcagaagtgcttgatgaaaatcaaaagatgttactgatgattttgaaagaggttcaagatcaagtaatgctgaatgcattcgttccgtcgggaatgagtttatctgaggcaatgatgcaaaagtatgatgactatggtgagcagttgaaaatataccacgagctcgaacatagcgtttctgatgattcagcagccaaattacgtggtgcgtatcgtgattataatgacaatataataaaaagaattgacggcgataataaaaaggacactttttacaagagagtcaaaaacatattaactaaaatatcaaaagaatacgttgatcaagatgtgttagagtcttgcggcaagttaaagaaactcatagacgaaaacaagctttttatcagacagcgaacggcagcaaatggtgttttgccgcatcaactgcatcaaatagagatgcgtaaaattattgataatcaaaaagagtattacccttggcttgctgagccgaacccgaacgaaaagagaagggtctactcgaagtacaaagttgaggagttgattgctttcagaattccgtattatgttggaccgttagttgatcccaacaacgctgacaaaaacaaagaagcacgtttttcttggatggttcgcaaaaaggacggcgaaattactccatggaatttctatgataaagttgactgggcagagtccgctaacaattttatagaacggatgaagagcaaggatacttatcttcttggtgaagatgttgttccaaaagaaagcatgctttatcaaaaatatgaagttctgaatgagctgaataatttaagaattaatgacagtgggttaagtgattcgtttgaagatgtcaagttaaaacaagcaatctataatgatttatttaaaaaacaaaaaattgttaaaatcacagatttacaaaattatcttgttcaaaatcataaatatttggtcaaaccaaaaatcagcggattggccgatgaaaatcgtttcttatcatctttgagcacatacagcgatttaaaaacaatttttggtgacaaagttgatgacaggacatattttaacgattttgaaaaaatggtggaatactctaccgtatttgaagacggccatgattataatcaaaagcttgatgaatatacctggcttactaaagaagaaaagtacaaaattggaaagaaacgttatcgtggttggggaaagttgtccaaaaagttgttaacaggtttgcgcgacaaaaataatcatacgataatggataatctgtgggaaaccaatcgaaactttatgcagattcaaacagcagatgaattttcaaaacaaattgctgaagaaaacgaaaggcatttgaaaggaagcgttagtgacgcaataaatgacatgtatacgtctccggccaataaaaaagcaatcaggcaagttttaagggtggtcgacgatatacaaaaagcaatgggatacgcaccatcttcaatttcattggaatttgctcgtgaagacgggccgtccgtaaggacagtgtcgagagcgaacagaatgaagtccatatatgaaaagtacgcttctgaagttagcgaagaagtgatgaaggatttggacggcgtgatcaaggataagaaaggcttgaatgacaggttatatctttattttgaacaacaaggaaaagatatgtattctggtcatccgcttgatttcgacaaagtaatcagtggtcaagaatatgatattgatcatattttgcctcaagctgtcattaaggatgattcgcttgataatcgtgttttgacgactaaagcactcaataacgatgttaagtcgaagggtgttccgtgcagaatgtttaatgggatgcatagtttttggaagaatttgtatgacaaagggtttatttctcgtaggaaattcaataatttgacaactaatcctgaaaatattgataagtataagatgaaggggtttgtaaatcgccaactagttgaaacgcggcaaattatcaagcttgttgccaacgttttaaacgataaatatcaaaatgacgatgttgacattattgaggtaagggctgaacttacgcatgatgtcagaaagcatttcaaattctataaaaacaggaatgtaaatgattatcatcatgctttcgacgcttatttgacgagctttattggtcattaccttttcaaaaagtatccaaatctcaggccgttatttgattataatgattttatgaaggtgtcggataacgtatttaagcaacttcgcggaaataatttcttaggtgagtttttgaataaaactggtgatatcatcagtactgatggaaatttcgttctcaataaagaagaaatgattaataagctgaataaggcttatgcgtttaagaagatactggttacaaaagaagtgggacagcgtacgggagctatgtttaatgaaactagatacccggcgcctaacagtagaaaagctgctctcaaatatagaagaatgccaaagcctgactcattaataagcgtaaaagattacaaaaatacagatatatatggtggttatagcggtaaaaatgatgcatatatggttattgtcgatatgggcaagcaatatatggttgttggtgttcctgttcgatatacggaaaaacttgataaactgcgtatcaagcattctgaattgtatagggatgaattacgcaaagttctttcgagggacaagacgctattggattctaagggaaatgttaagcgatttgatatcgttctagatagagttctttatggtcagcttattgaagatggaaatgagttatttactttgggaagctcaaagtataagcgtaatttcagacaattgtttttagataaacaatgtatagaaattcttgattcgagtgcaactccgcaacctactgatgaggagcttatatgggtatatgatcaaatattggataaggttgataaatactttgaactctatgatattaatagacaaagggaaacgttgagaaagggaagagcggcattttgctcattgcctaatattagtatgaaaaaggatgatgtaacaaaaaagaaaatattaaatgaaatattagttgcattgcatgcaaatgaaagtgaatctaactgcgaaaaaattggaaagaaggtttttgggagattgcaagtcccaggcggaattaaattatccaaggaagccaaacttatctatcaatcaccaacaggtctatttgaacgagtcgtatatttgaaagatctataa

SEQ ID NO: 349 - DNA, 4110 bp, Lactobacillus sakei carnosus DSM 15831
atggcgaaaacatataatatcggactagatattggtacaaattcaattgggtgggcagtcgttgatgaccagaaccacttaatgagtattaaaggaaagtacggttatggtgttcgattatatgatgaaggaaaaacagccgaagaacgtcggagttttcgaacaacacgtcgtagattaaaacggcgtaaatggcgattgagtttattaagagaaatttttgaaccacaaatcacgccgcttgataacacatttttcttacgtcagaaacaatcaagtctaagctcaaaggataatcgtaaattatatccagaaatgagtctttttaatgatcgaacggatactgatttttatacacaatatccaacaatttatcatctgagccgcgatttaatgactaagaataagcaatttgatattagagaaatttatttagcaatgtatcatattgtgaaatatcggggacattttttgaatgaatcaccggtatcatcatttaaaagtagtgaaattaaattagctgaaaattttgaaactttaaaccaaatatttaacgaacgatttaatgaatccatgttccaattagctgtaaatgattttgatgatttgaaagcattattgctaaatgaccaacaaagtgctagtaatcgacagaaaaaagcattgggaatgatttatgttccaaacgaaaacaaatcacttgagaagcaaaataaggcaattgccactgagttattaaaagcgattctaggcttaaaagcaaaatttaacgtcctaaccggaattgaagtcgatgacgcgaagccatggacattatcatttaactctgaaagtttcgatgaagatattgataaggcagcaaccaatattgatgatgacagccgggaaataatagcaatcttacagggcctttattcgggtatcttattagcaggtattatacctgaaaatcaatcattatcggaagcgatggtcgaaaaatatgaccagcatgctgctcatttaaagcaattaaagtcaatctacccactgttgagtatttctgataaaaaagcaattcaacaggcctacaattattatattgatgggcaagataatgctaaagcttacagcagagaagatttttatgcagcaactactaaagcattgaaatcatatcaggataacgaaacgattgctgaaattctaaagttaatcgaacttgaacaatttatgccaaagcaacgaacaaaagataatggtgcaatcccacatcagttgcaccaacaagagctagagcggattattgaaaaccaacaaaaatattatccttggttggcagaacttaatcctaacgaaagtcggcgtaaaattgctaagtataaattggatgagttagtggcatttagagtgccttattatgttgggccattgatcacgtctgaacagcaacaacaaagttcgaataaaaaatttgcgtggatgattcgaaaagcagagggtaagattacaccgtggaattttgatgaaaaagtggatcgacaagcatcggcaaatgaatttattaaacggatgacaaccactgacacctatttattggcagaagatgttttacctaaacaaagtttggtatatcaacgatttgaagtgctaaacgaattaaacggtattaagattgatgatgtaccgattacagttgaacaaaagcaacggatttttaacgatttgttcatgatgcaagcaagtgtttcggttaaaaatattcaagattatttggtttcgaagggttattttgctagtcggcctgaaattacgggattatctgatgaaaataaggttatcagtaggttgagtacgtaccatgatttgaaggcaatcttgggcggaattgttgatgaagccaacaaacaagctgatctagaaaaatgtgttgaatggtcaacaatttttgaagatggtaaaatttttgtcgaaaaattaaatgaaattgaatggttaacagatgaacagcggaaacgattatcttctaaacgttatcggggatggggccgtctttccaataaattattaaatcagattgttaatgaaaacggtcagagaataatggatttattgtgggatacgacagacaattttatgcggattgttcattcagaggaattcgataaattaattagtgctgctaaccaaacgttattatccaaaaatgatgttcaagatgtgattaatgatttatatacgtcacctcagaataaaaaggcattacgccaaattctattagtggtatctgatattcaaaaagcaatgaagaatcaagcgccaagtaaaattctaattgagtttgcccgtgaggatgaggcaaatccacgtttatctgttcagcggaaacggcaagtcgagcaagtttatcaaaatattagtaaggatatccttagtgattctgatgttaaggcggaattaaaggatttaactaacacagcattagcaaatacgcgattattcttgtactttatgcagggtggtcatgatatgtatactggagaaactttaaatattgatcgcttatcagaatatgatattgatcatattttaccgcaagccttcattaaagataattctttagataatcgggttttggtatctgcaaaaatgaatcggagcaaatctgatcaagtaccgttaaatgactatactgaagaacgatttggctcaaaaatgcgtgttcaatgggaacaaatgttacgagcaggattaataactaaacgaaaatatgataatttaacgttaaatcccgatcgaattagtaaatatgctatgaaggggtttatcaatcgacaattggttgaaacacgacaagtgattaagttagtaactaacttattaatggatcattatgaagatgatgaggtccagttgattacagttaaaagtggtttgatacatcaaatgcgtgagatgtttgattttcctaaaaatagaaatttaaataaccatcaccatgcatttgatgcttatttaacggcttttgtgggaatctatcttcttaaacgttaccctaaattaacgccattttttgtttatggaagctatcaaaagaataataccaatgataagtggcgtaattttaatttccttaacgatttaaaaaaggaagaagtaatagattcagattctcacgaggttatctggaataaagcgcaaggacttgttgagttggataaaatttatcaatttaagaaaatcttagtgacccgtgaagtccatgaaaatacaggtgcactatacaaccaaacgctgtattctgctaaagacgataaggctagcggtcaaggtggtaaacagttgattcctgccaagcaggaccggccaactgcattatacggtggttactcgggcaagacggttgcttatatgtgtattgtccggattaagtctaagaaagaagatacgtataaggtttgtggtgttaagacgagttgggtggcagaattggagagactatctgattctaatgaacaattagctagtcttaaggcaaaattgatgcctaaatttacgaagaataaaaaacaaaaaggaaaaacaattcaagttaccgaagattttgaaatcattgttcctagggtattaattaatcaacggttttatgataatggacaagaaataactctaggatcagcaacttataagcataatgaacaagaattaatgctaaataaaaaggcagttaaactattgaatggtcaattatcgttagttgaggccgaaacattagcaccgcaagtttatgatgagattttaaaacaagtgatgaaatacttcccactgtatgataccaatcaatttagaacaaagttgaagatgggtaaggaacaattcatcaaattaccgtggaagaataaatgggacggtaataaattgattcatgtgggccaacaaacagtattagatcgcattttaattggattgcatgcaaatgcagcggtgagtgacttaagtaccttaaaggtaacaacaccatttggtaaattacaacaaccatctggaatagcactttccctaaatacgaaaattatctatcaatctccaactggcttatttgaacgacgagttgctttaaggggtttataa

SEQ ID NO: 350 - DNA, 3450 bp, Lactobacillus salivarius UCC 118
atggaaagatatcacattggcctagatatagggacttcgtctataggatgggcagtaataggcgatgatttcaaaattaagagaaagaaaggaaagaatttaataggggttcgtttatttaaagaaggagataccgccgcagaacgtcgaggtttcagaactcaaagaagacgacttaacagaagaaaatggcgattgaaattattagaggaaatttttgatccgtacatggcagaggtagataaatatttttttgccagattaaaagaatcaaatctttccccaaaagacagtaataagaaatatttaggttcattattattcccagatatatctgattcaaatttctatgataagtatccaacaatttatcatttacgaagagatttaatggaaaaagataagaagtttgatttaagagaaatctatttagcaattcaccatattgtcaagtatcgtggcaattttttagaaaaagttcctgcaaaaaactataaaaatagtggagcatcaattggatttcttttagaagaggttaacgatttatacggtaacatcatcggtaatgaagacgttgccattcttgataatgataagtttgaagatgtagaaaagataatcttaaatgatgaaattagaaatattgataaacaaaaaaatgtaggaagactattagtaaaagataaaaaggaaaagaatatagttactgcattttctaaggctatttttggatataaatttaatcttgaagatttattgttgatagaaagtgatgaaaagaataaattaacatttaatgatgaaaatattgatgacatttttaatgaattatcacattccctaaatgataaccaaatggatttactaactaagactagggaaatctactttaagttcaaattaaatatgattgttccaactggatatacaatatctgaatccatgatagaaaagtacgagatgcacaaagctcatttaaaaatgtacaaggaatttatcaatactctaaatgcaaaagatagaaagatcttaaagaatgcttacagtgactatattaataatgaaaaagctaaagctgctaacgctcaggaaaatttctataaaactgtaaagaagactattaaagaaaatgattcagatacggctaaaaagattataggcttaattgatgaaggaaattttatgcctaagcaaagaaccggtgaaaatggtgtaatccctcatcagttacatcaaatagagttagatagaattattgaaaatcaagccaaatattatccatggttggcagaagaaaatcctgtagaaaagaatagaaaattcgctaaatataaattggatgagctagttacttttagagtgccatactatgttggaccactgatagataagacagagtctaataaaaatgaaaaagaaacaaaatttgcatggatggttcgaaaagcaaaaggaacaataactccatggaatttcgaaaatttggttgatagaacagaatcagctaatcgttttattaaacgcatgacttccaaagatacatatataattggtgaagatgtattgcctgcttctagtttgctatacgagaaatataaagtacttaatgaattgaataatattaaagtaaataaaaagaagttagatgttgaacagaaacagcatgtttatttagatttgtttacaactagaaagaatgtaacaaaagatgatctagcaacttccctaaattgtgatgtagaaagtattactggactaaccgataacaaaaagtttaattcttcactgtcaagttatattgatttaaaagcgatattaggaaatatagtagatgattacagtaaaaacgaagatttagaaaaaattattgaatattcaactatttttgaagatggtaatatctacaaagaaaaattaagtgaaatatcatggttgactgatgagcagattgaaaaattatcaaatattcatttcaaaggatggggaagattatcaaagaaattactaacacagattactaatgagaatggtgaaagaattattgatacattgtggaatacatctaataattttatacaagttataagtgatgaaagtattcaagcaaaattagctgaaattaacggtgagtatgcgaataaatataacttagaagatatattagatgaggcatatacatctccacagaacaaaaaagccattagacaagtaatgaaagttgttgaagatattgaaaaagcaatgaagtgtgagccaacatctatagctattgaatttactagggaaaaacgaaagagtaaattaacgaatactcgttataagaaaatatctgaaacttatgagaaaattacagatgaactaatctccgaatatgaattaggaaaattacaatcagaattagatagtaaagtcaataatatgagagatagatattatttatactttatgcagttaggtagagatatgtatactggtgagaaaatgaatattgatgaattgcaccaaaaatatgatattgatcacattcttccacaatcctttataaaagatgattcgcttaataacagagtgttaactagtaaaagcgtgaatattaaagaaaagtcagacaagacagctgcagatttgtatgcagcgaagatgggtgatttttggcgtaaactacgtaaacaaggtttaatgacggagcaaaaatataaaaatttattaactaggacagacagtataaacaaatatactaagcaaagtttcattaagcgtcaattagtagaaacaagtcaagtggtaaaattggctgctaatatattgcaagataaatatcgtaatacaaagattattgaaataagggcaagattaaatagtgatttaagaaaaaaatatgagctgataaaaaatcgagaagttaacgattatcatcatgctatagatggatatttaacaacctttgttggacaatatctgtataaagtatatcctaaattacgcagttattttgtatatgatgattttaagaagctagatagtaattacttgaaacatatggataagtttaactttatatggaaattagaagataaaaaagcagaagatgtctacgataaggtaaatgatgaattcgttttaaatgtgccagagatgaaagaatatatacgaaaaatttataattataaatatatgttagtttcaaaagaagtaactactaaaaatggtgcattttatgatcagacaaaatataatgctaagacgattaacttgattccaataaagaaagataaacctacaaacatttatgggggctacaaggggaaagtaagtagctacatgatgctagttaagattcaaaagaagaaagaagtaatatataaatttgtaggtgtaccaagactttggactgacgaattagatagattaattgatactgatgaaaagaaagcattattgaaaaaatag

SEQ ID NO: 351 - DNA, 3996 bp, Lactobacillus sanfranciscensis DSM 20451
atgaataaacaaccatataatattggactagatattggaacgagttcagttgggtggtcagccactgaactggataatcgtttattacatattaagggacacaacggaatcggagttcgtttatttaaagaaggagaatcggcagctgatcgtcgtggctttagaacaactagaagacgattagctcgtcgaaaatggcggcttcggttgttaaacgaaatttttgctactgaaattgcaaaagttgatccaagtttctttgccagattaaaacaatcaaacgtttcgcccaaagatccaaataaaacaatgtttgagaatatcttatttgatgacgaaaatttagatgatcaaaaatttcatcatgattacaaaacaatttatcatttgcggcaagcaattattaatcatccagaacaaaaatttgacattagattaatttacttagccatgcaccatattattaaatatcgtggtcattttttgaatcaagcaaatgtgcaagattttaaaggtggaaaaattgatttagaaaaatcttttaaagcgttgaatgacatctttgaaaatcaaggacgtgatttacggcttgtgactgataaggctaatcaatatgtaaaagtacttagtgataacgccaaaactagatctgatcggaaaaaagaattatcgaagttattgtatgttccaattgataaagatactgataagaatagtaagaaagttacgggagaaatcctcaaggctattttaggtaataaagctaaatttgatgtgatttttggcattgaggtggaaaatcctaaagaatgggtcttaactttcaatagtgatgattttgacgataaaattgaaggtttatcatcccaaatgacggatgaagattctgaaattcttttaattttgaaagaactttattttgctttgaacttatctgatattttaaataactcagttactgataaaaatgcaaaaactttatcagaagcgatgattaaccgttacgatgatcataaaaatcaattagcaatgttgaaaaaagtaattgatagttctgataagaaacatgcaaaggaattaaaagaagcttattcagcatatattgatggggaaaataataaaaagatttcttttgaagatttaaagaaacgaattcaaaagaacttagttgattcagaattatcacaaaaaattaatgatttattagatcatgattactttttacctaaacaacgttctaaagagaacggtgccatcccacatcaattacaacaacaagaattagatcaaatcattgaaagtcaaaaacaatactaccctttcttagcagaattaaacccgaacgaaaaacgaagtcgtcaagctaagtataaacttgatgagttagttgctttccgagttccttattacgttgggccgatggttgaagttaccgatagtaatcaagaaaataatggtaagtttgcttggatgattagaaaagaacaaggtgaaattaccccttggaattttgacgaaaaagttgatcggactgaaactgctaccaaattcattactagaatgactacgaccgatacttatttaattggtgaaccagtgcttcctaaaaatagtttgttataccaaaaatttgtagtcttaaatgaattaaacaatttaaaaatcaatcaagaaataattacgcctggacaaaagcaatatctttatgaacatgtaatgaagaaaaacaagcgggtgaccttgaaaaagattgcagatgccttagtaattaaaggtgactatccttacgctccagaagttaagggaacaactgaccaaaagaatttaaataacggattaacgacttatatcgatttagccaaaatttttggtaatgaattagatgatgttgatcgagaagcagactttgaaaaaatcatcgagtggtcaacgatttttgaggatcaacatatatttgccttaaaacttcaagagcttaaatggcttacggaaaaacaacgtaatcaagttgttaaacttcgataccaaggttggggtaaattatctaaagaattacttgctggtttagttgatgataatgggcaacgaattattgatcttttgtggagcgataatcaaaactttatgcaaatcgtaaaccaaaaatcatttaaagaatcaattgctgatcataatggtgctcacttagaagagaaaaatttaaaagatgttatcaatgatttatatacttcacctcaaaataaaaaagccattcgtcaggttattttagtggtcgatgacattattaatgcagttggttatgaaccagctaatattatgatggagtttgcccgtgaagattctaacgaccatcgcttaactaattctagaagtcgacaattagaaaatgtttataaggatattactaatagttggtttgacaatgatagtgttaaagatgaactagaggacaaaattaaaaataaagataagtttacagaccgcttgtatctatactttacacaaggcggaaaagatttatatactggtgaaccattaaatattgatgatttatctagttatgacattgatcacattttgcctcaatcatttattttagataattcgttagataatcgggtccttacttctcaaagaaataatcgggtttcaaaagaagatcaattgccaggtgaattattcggtactaagatgcacgcattttggaaacgattaaaagcagctcatttaattagcaataaaaaatactataatttaacgcttacacctaattcaattagtaaatttaataatcaaggacgttttattaatcgtcagctagttgaaacgagacaagtaattaaattagctgctgaaatacttcataatcgttattctgaagaaaaaggaactaacattgtgacaattaaagcaaatttaactcatcacatgcgggaaaaattcaatttctataagaaccgaaatgttaatgattatcatcatgcctttgatgcatatttaacggcttttgtgggaaactggctattacaacaatatcctaaattgaaaccttattttgtatacggtgattttgctaaaactgaaattaataatttgaagtcatttaacatgctttataaatttgaacaagctcaccaattgaatgaaaaagatgggaagattgctaaagatgcggatgccttattaggttatatgaaaaatgtctatcactttaagaagatgttggttactaagaaattggaaactaatcatggggctttatttaaacaaactttgtacccatcaccagctcatgatattaaaaaacggcaattaataaaaccaaaggataatcggccaacagatatatatggtggttatacacatgaagaaagaaaatatatgtctttagttaaagtgattgggaaaaaagataacgaatatagaatggcgaatgtaccacttttaaaaattaataagaataatgatattaaagaaattttaaaatcacaattttctaataagaaattcgaaattgttttacctaaagttttaaaaaatcaattatttagtgaaaatggtgcattatttgtgattggcagtaaaggatataaatataatgctaatcaacttgttttatctgatcttgatatgaaacttttaaatgatttaagtaacaataaatctattgatgaagttactatcaatcaattatttaaaaatattgttgatagtactaataaatatatgccattatatgaaattaaaaatttaaatgaagtagttgaaaaattcaataatctagaatttaatgataagaagaaaacgataactgatttcttactggcaactcatgctaatcctactatgagtaatttgaaaaatattggattgccatcttactttggtagatttacaagtggaaatgctggaattaaattaagtgaaaatgcaaatgtaatttaccaatcaccaactggattattttcacgaaaagttaaaatttctgatttttaa

SEQ ID NO: 352 - DNA, 4041 bp, Lactobacillus saniviri DSM 24301
atggttgaacattatgcgattgggtttgatattgggacaggctcgacaggatttgccggtgttgaccctaatggtaagcttgtgcgaatgcgcggcaagaatgtttacggggtttatcgcttcaagggtggcgaagcagctgcggatcgacgtggttttcggacgacacggcggcgaatcaagcggcgcaaatggcgcttgcggtttttaaagagtttttttgagccctacatagcaccaattgatccagaattctttttacggcagaagtattcagctgattcgccattggatccaaaggggatccgagcggataagggccttttgtcagacatgagtgatcaagagtttcatgcgaaatatccaacgatttatcacctgcgctaccagttgatgcacgagaagcgacaatttgatgtccgcgaaatttatctggcgatgcatcatatcatcaaatatcggggtcactttttaatcgaagatggcgcggacaactttgacgctaaacaaatcgatttctttgatcaattccaacgaatggctgcggtgacggcgggcttgcctgaattagaaactttggtcgtgccagatgagacacaatcagatgcatttaagcgcgtcttgtttgacgaatcacagaccaagtctgatcggcaaaaagtattggccagtcaactgctggatattcaagataatcagagtaaggcgattaaggactttattgcagcactaactaaggctgtggtgggcatgaaggctaacttagcgacattgacatcaacagctattgagagtactgacaagaatgactggaccaaaccgcttggccagctcgatgatttcttactcaagcatgaagaagatcttgatgaggatgggtatgcactgattgatgcggctaatcagatgtattcggctgctgtattagccgcgcttgttcctgaaggcatgggtttctctgaggcaatgatggcgcgttatgcgcaacataagaaacaattagcgttgtataaacaagttattgccagtttgcctgataagacacagcgccatgagctgaaggatgcttatgcggactatattgaacatgccgcacaaaatccgagagatgcattttataagcgtgtgaccaaggtactggaaggtgtggactcagcagacgcgcgcacagttatgaccgctatctcacacgatgagtttttattaaagcaacgcacattgagtaatggcaaaattccttatcagatgcagcagcatgaatttgatgccattattgagaatcaaaaagcttattatccatggctggccacgccaaatccagttgaggcggatgctaagcgcctgccgtactaccttgacgaactgattggctttagggtgccttattatgtggggccaatggtaacggaaaagcagtcacagtttgcctggatgattcgtaaagccgatggagaattgacaccatggaatttctttgacgtggtcgatcgggagaaaaccgctaatcgattcattcagcggatgcagacaacagataaatatatcctgggtgaagatgtcctgccgaagcatagtattttgtaccaacaatttgaggtgctcaatgagctgaataatattcgtgtagagaaacatccactgacaactgagcaaaaacaatttatctatcagcgattatttgttgatcaacagcgaaaaacaattaccaagaagaatcttcaagataccttagtggccatgggtgagtttgataaggcacctgatatcggcggtttggctaaggaagacgtgatgatgagcagtctcgcgacgtttgctgattacagcaagattttacccgaagcgattagtgaccccacacggcaaaatgatattgaagatatcattgcatggtcaactatttttgaagacacacagattttctttgataagttgaagacagtggactggttgacgacccagcaacgcaagcgcttggcaagtattcgctacaccggttggggcaaattatcgaagcgattactgcagcagattccaaccagcaagcacaccaacgtgatggcagcattatgggcaacgagcgataatttcatgcaaatcctgcaagatgaacaattccaagaaggtctgtatgatgccaatcgcttaccagaagagacacttacgccggatgaacaggttgaaaaaattctggatgaagcgtacctgtcacctgccgataagaagggcgcgcgtaaggttatcaaggtgatgaacgacattgttcgcgctaatcacggtgttttacccgaacaggtatttctggaatcagctgatgatccgcaaaaaaataagcggcgtagtgtcagccgcagcaagcaattggaagaaaagtacagacaagccgcacagagcttcatcgatgaagcggttaaggaagaactgaatgcacaaattgtaaacagtgcagaattcaatgaccgattggtactatacttcactcaaaatggacgcgatatgtatactggcaagcgattagacattgaaaacctgggtagttaccaaattgatcatattttgcctcagtctctggtaaaggatgactcactggataatcgcgcactgacagctagagatattaatgcggagatgagtaatcagttcgtttctgaacgtttcgggctagggccacgggctttttggcaacaattgaagaataacggtttgatcagtggccggaagttccgtaatttggttatgcaacgtgatgagattgataagtacgcgccgggattcattaatcggcaactagttgaaacgcgacagattattaagacggttgagcaaatcattcatcgcttgtggccagatattcagattgtgacgattaaggcaaatttgacgcatcaggtgcgctctgaattgggcttccccaaagttcgtgagttgaatgattatcatcacgcgtttgatgcattattggctgcccgtattggacagtacttgttggaacattatgctggcttaaaacccttcttcacttatggtgaattcaagcgcggagacaccaagaaatacgggacaacgaattttttgcggcggctaactaaagataataaggacaaaaaaggtgagttgctacctgaagtaagtgattggattgacagcatcgattccatttacaattataagaaaatacctgtggtttgggaaaacacaacgaacatgagtgccctctttgaccagacgatttatccccgacctgatcgtgatacgacaaagcgcaaattgattccgacgaagcttgataaaccgacagatatttatggcgggtattcaagcgctaagacagcctatatggcagtgatgcgggtacagactaaaaaaggtactgaatacccggttttcaatattcctgtctcaatcgcgtctcagctgaatcgtattactgatcagacgatgttaaagcagcaagtcaaacagttcattatcaacgctgaacaaagtgcaagtaaaaagaagttgtacgagagtggcgatgtgattttgtcacgggttgcattaggacaacgatttactgacaaaaattatggtgaagttttcttgatttcaaatatggaagtgcagaatcctcaatcgctttggttgggtcgcgctagtcaacaacgattaacgcgtgaaccagagggcaatgaaaagccagagacatcgctggccgatatttatcagcaaatcttgaaacaggtcgaccgatatttcttggcctttaatattcgccaacaacgccagaaattattgggcactttggaccagtttacgagtttacctgtaggtcgagtcaatgagcagacacgcactgatcagaatcagcgctccattattgcgagagtgatgattgttctcggcaaaggctcgagagaggagaaatttccagaatttggccttagcgcgttaggtcgactggttcgtactggtggtatcacgctctcagaagatgcccagatcatttaccaatctccaactggattgtttgaacgtcgggtggcactgaaggatttatag

SEQ ID NO: 353 - DNA, 4038 bp, Lactobacillus senmaizukei DSM 21775
atggttgaaaaatatggaattggattagacattgggaccagtaccctgggctggaccagtgtcgatgagaatggcaagattcagcgtctaaaaggtcaaacggcgctggggacacggttatttaacgagggacaaacggctgaggaacgccgtgggttcagaacaacccgccgtcgcatccaacgtcgtcgctggcggctacggttactgcgagaaatattcgacgaaccaattggttccgttgatgcgggattttttgctcgtcagaagatgtcgagcctatcaccgcaagatgaccgattcgaagatacttaccgattattcaataatcaaacagataaggccttccatgacgagtatccaacgacttatcatctgcgtcaggcgttaatgaattccgatcgacaattcgatattcgggaaatctatctggccattcatcatattgttaaatatcgcggaaactttttgcgctcaggtaaaccagccgactttaaaacggggaagcttgatttaaaggaaaagtttgaagagattaatgcagactggcaaacgttaattagtgaagatgccccacaattaccagtcgatgatttgacaaccattaaggccgttttggttgatggttcacgaagtcggtcagatcgacaacgcggattagtaaagctctggatggccaatgagaccgttgagaagaattggaagccagtcatgactgaattggccaaggccattttggggctgaagacaaaattgtatctgttgactggtctcgatttgcccaaagaggaccaaaaggcttggaccttcagtctggataccttggaagaccatcagggagatattgacagtttcttcgatgaccatgctcagcagttgatcgatcggttagccgagctacgggcaatgattcagttaacggaaattattcccagcggcctcaacttttcacagagtatggttcagcggtatgaagcacatcggtctcacttagagatgtataaacagtatgccctggatcagacggatcctaagcgtaccaaggcgttgagagcagcttataatgcatacatagatcaacatgaaattgctgatgatttttatacggcggttaagcgagttactaaggatgaccagagtgaaacggccgaggaaattaaccggctaattgggttggaacagtttatgcccaagcaaagaacgaaggaaaacggggttattccatatcaagtccatcaacaagagttggaccaaatcattgcccaccagaagaagtattatccttttcttgggacggaaaatcccgtaatcgatcaccgagaatctcagccctatatgctggatgaattggtgagtttccgggtcccttactacgtgggcccaatggttgccgccaatcctgagctcaagacgaccgagaatccgtttgcctggatgattcgtaaagctcagggtgaaattacgccttggaacttcgatgagaaggtcgatcgtaagggttcggcgacggcatttatcgaacggatgaagactaccgatacctatttgttgggcgaggatgttttgccacagcagagtctcctttaccaacggtttatggtcttaaatgaattaaataatattcggattgatgatgagttgttgacgaccaatcaaaaacagtgggtatttgatcgtgtctttaaaggaaagggcaccatttcagctaagcatctacaagatgccttgaagcatcatggcgaaactgatggtttgcccaagatttccggactagcagatcctaccaagtttaacagtgctttgacgtcgtaccgtgattttcagaaatggttaccaaatgatatcgatcggaaagacagaactgccgatattgaaacaattatcaattggtcaacggtatttgaagatacgcatatttttgtggaaaagttgaaggaaattgagtggttgacggcagatcaacggcgacggattgccagcaatcgttatcgaggttggggccgcttatctaagcacctactaacagaaatcaaggatgaacagggcctgtcgattatggaccagctttggcgaactcaacataactttatgcagattgtgcatgaaccagactatgcgaagcaaattgaagcggctaataccgtgggtatggccaagcaggacattggaactgttattaatgatttgtacacgtcaccacagaataagaaagccattcggcaagtactggcagttgttaaggatattcaaaatgcccatcatggcgtagcccctagctggattttcatggaagccgctcgcggtgctgaccagaatccgcaacggagtcggcaacgtcagcgtcaacttcaagacttatacgccaagactgccgcagatctggttgataccgaagttcaacaggaattgacggataagattaaggataaggcgaacttcaccgatcggttgatgctgtatttcttgcaaaatggtcaggacatgtactcgaaggaaaaattaaatattgaccgactgtcggagtatgacattgaccatattctgccgcaggccttgatcaaggatgattctttggacaaccgcgtattggttcaccagagtattaatcgaaataagagcgatacatttgcttccgaaaaatatggtgcgaagatgcaaggcgcctggcaccaatggcgagcagcgggtttaattagcgctcgtaagcttcgtaatctggagatgcgtccggatgagataagtaagtatgcgaccggattcattcgtcgtcagttggtcgaaacccgtcaggtcatcaagttggttacggaaattttgagtcatcagtataatccagaagagaccaagttggtttcggttaaggcggggctgtcgcatgagctgcgacgcgaggccggtttgccaaaattacgggatctgaatgactatcaccatgccatcgatgcttatttggcggcacggattggtacgtatcttctaaaacgatatccacgactggaacggttctttgtttatggccaatttcaaacgagtcgtttggatctacggcgatttaactttattcatgatttggtcaaaagcaagcaaggcgttattgtggatagcgatactggggaaattctctgggaccgtcagaaagatatcgactatattaagcacttgatgggcctgaaacatttgctggtcacacatgaagtttatgatagcgctgcggaaatgtatgcacagacaatcttcaaagcttctgataacgacagtaaggttttgattccgacaaagaatgatcggccgacggcgatttatggcggctacacgaagcgacggaatgggtacctagctatcctgaagattactgaaaaaaaggcagaaacttatcgtgtagttggggtgccgactctgtatatgagtcaacttgcaacggcccgttcgcacagtgttgaagctgagaaagcgttgctgaaatcgttgatggcgccagagattttaagcgagtccaaggtagttagttttgaggtcgttgtgagccatgttcatttaaaccagttggttcgggatacagtattcggacccgcccattactttgggctgggaccattccgctatgtacgcaatttccaccagttggttttaccattcaaggatcaggagattttagttaagcgaaccccgactgatgaggaattaaatacagtttttgaagatatttgttggcaagttgagaattacttcgctgtattcgatattaatgggtttcgtaatgccttgaaaaaatcaatcgataagtttgaacaattaccgattgaaaatgtttttaaagacaaaaaactagtcacacaaggaaaaaaagaagtcttggcgtttgtaatgcagggactgcacgcaaatgcaagttatcggaatctaaaggtgtcattaggtattaagacaccgttgggccaactacaattaacaaaattcatgttatcaagggatgctgagttaattgatgaatcaccgacgggcttgtttcggcgaattcggcgtctaaaggatttgtaa

SEQ ID NO: 354 - DNA, 3423 bp, Lactobacillus tucceti DSM 20183
acttgtgtatttttagttaaattggggggatttgaagtggatcgaaaaataagtttggggttagacattggtgtttcatcagttggatatagtgtaatagatgttgatactggtaaagttttagaacttggatcacgcctgataaacggtaaaattggtacagaaaaccaagcgcgtcgagagatgcgtggcactagacgattaatcaatcgaaagaaacaacgtcgtaaggatacagttaaattatttaatgaatttaaattgattgattcaaaaaaagatgaacattattttgaccacttcgcaaataattctgatccgtatgaattgcgagtcaagggattgtctgaaaagttgtcactttcagaaattgccgatggtttgtatcatattgttaaaagacgtggtattagttacgatttaaaagacgctgatgaggaatctgaaggttctgaatatgaaaatggattgaagatcaataatagtgagttaaaaaatcaaactccggcgcaaatacaattaaaacgtttgaatgaatatggtgccattaggggtaaggttgttattgatgaagaaaaaattttattgaatgttttccctacaaaagcataccttgatgaagctaaaagaataatagaaaaacaaagagaattttatcctggaattttaacagaggaatttgaagaaaagtattgtcaaatacttactagaaaaagagactactttgttggaccaggtagcgaaaaatctaggactgactacggtatttataaagaagatggtcgaacactaaataatttatttgaggaattaataggacacgacaaaatataccctgaagaactaagagcttcaggagcatcatttactgcacaactgtttaatgttttgaatgatttaaataatttgcatatttcatcatatgaagatcaaaaattaacgactgaaaataaagaacaaattatttcggaattaaaaagtacaacttcaaatgtcaatatgatgaaacttattcagaaaattgctggttgtgaagaatctgatatcagtggttatcgaactgacaagaattacaaacctgaaattagctctatgcgtatttatcgcaaagtccataaaaaacttttagaatctgaaattgatataactaattggccggatgattttataaataagttaagtttcattttgactcttaatactgaaaatggtgaaattagaaatcaattaaaaaatcgtctgcagccagaatatgattttcttactgatgaattgattcagacaattattgataataaagaaagttttgatattaaatctaataataaatggcatagattctctattaaaacgatggagctgttgatcccagaaatgataaaacgtccagttgaacaaatgactttgataaatgaaatgggattgatcaaaaatagtggcaagaagtttagcaactataaatatttgccatataaaaaaattgctgaagatatatacaatccagtagcatctaagtcagtccgtgaagctttgaagatagttaatgcaattttaaaagaatatggtcatatcgagtatattgttgttgaaatgccacgtgacaaaaatgaagatgaagcaaaagatcaaatcgaaaagttccaaaaagcaaatggacgactaaaagatgctgcattggaagaattcacagaggcgattggagataaatccaccgttgacaagaaattgggagtacataggtctaaactcctttttaagataagactttggtatcaacaaagaggaatggatctatatgagggcaaaccaatatctgcagttgatttgttaaataatcctgatagttttcaaatagaccatattattccacagtcagtttcttttgatgatagctttaataataaaacactttgtaattctggcttgaatcaaattaaagataaaaaaacaccgtttgagtatatgaatgagggatatggtcaaggattcgattcaatgaaggccatggtaatgaaaaatccaagaatagatcataataaacgtaaaaattatcttttctctgaaaatgttagtgacattgaaactagaaagaggtttatttctcgtaatttagttgataccagatatgcatccagggtagttttgaataatttgcaggagttctttaaagaaaaagaatcggatactaagatttccattattcgtggtaaatttacttccaatttacgcaagcattggaagataaacaagaatagagatacttatcatcatcatgcaatagatgccactataattgctgcaacgccatttttaaatatttggaaaaagggttctagtattttcccttcaaatgttgaaagtgaagatttttttgatattaagactggtaaaattattggaaatgatgagtttaacaaatatgcgtatgatgaaccttataatggcttttataatgaacttaggaatgctactgatagaattaaattctctcatcaaattgataaaaaaatgaatcgtaaagttagtgattcaacaatttattcaactagagttgcaaaatcaccaaagaataaaaaagaatcagaatatatagttgcaaagatcaagaatatttatgatgcagatgaatatgctaaatttaagaggatttacgataaagacaagactaaatttttattaaataagtatgatccaaggagctttaatcatttagaaaagatcatgaatacttatcctgattcaattgaaagaacaatgagtaataataaagtgaaggtagtaagaatctcaccatttgaactttatcgtcaagatcacggtccagtaaaaaaatattccaagaaaaataacggacctgaaataaagcaacttaaatacttggataaaaaagtcggttctagtattgatgtcacacctgataacgctaaaaataaacacgttattttgaagtcattgaaaccatggcgcacagatatttatttgaatcatgaaacaggtgaatacgaaattatgggtatcaagtattctgatctcaagttcaataagggtgaaggttatggcattaaaaaggctaagtatttagaaataaagcatcgggaaaaagtttctgatgattctgaatttatgtttactttgtacaagaaaaatcgtattaaggttgagaatatggagactgatgaaagtgttgagatgctgttttggtctaggaccatggatagccaaaaggggtatgcggaactgaagccaatttataaatataaaacagaggatgataattggccaatttatgggaatgcaaagaaacaaattataaaaaaactgattcccaaaaactgtaaaatatggaaagtaaatactgatgtattaggcaatcctttttatgtagaaaaagaaggagaatatcctaaagatgtccttgattaa

SEQ ID NO: 355 - DNA, 3942 bp, Lactobacillus versmoldensis DSM 14857
aaaaataatctctggggcgcgcgcttatttaaagaagcagagaccgctcaagttaccagaggtcatcgttcaatgagacgtcgttatcgaagaagaagaaatcgtttaaattggctggatgaattattcgcagatgaactagctaaaatagatccttcatttttattacgaatgaaaaattcttgggtctctaaaaaagaatccactcgtaaacgtgacccttacaatttattcattgatgagaaatataatgatgtggattatttcaatcaatatccaacgatattccatcttcgtaaggaattgatcactgaagataagaaggtcgatatcagactaatttatttagcaatccacaatattatcaagtaccgtggtaacttcactcttgaaaatcaaaattttgatatttctcaattaagcagtaatttttcacaacaaatcagtgacttttttgctttgtttagtgattttggagtcatcatgcctgaagatttcgatcccgacaaaatcagtgatattttactgaatcccaatctttcaccttcgggaaaagtttctgaggcaatagcaactatctctccaaaaactaacgtaaaagccaaaataaaaattattttattattacttgttggtaacaacggtgatttgaaaaaattatttgatttagaaacaactgaaaaaatagctgttaaattatcatctcgacatatcgacagtgaattgccaatcattttatcagaactgaatgagcaacaagaaaatattattaccattgccaattctatttttggttcaatcattctaaaggactttcttggcgatgagacctcaatcagtgcggcaaaagtaatcagttttgaagatcataaacaagatcttcaaaaactgaaaactatgtggcgcgagacttctaacaaagaagcagtcaaagctggtaaaaaagcttatgaagattatattggtcatgaggactctgaaactttttacaaaaaaatcaagaaatttttggagaaagctcaacctgttgatcttgcaaataaggcactggcagaaattgaattggaaaattatctacccaaacaacggaaccgaaataatacagttataccttaccaactcaacgaaaacgagttgattgccattctagaccaccaagaaaaatattatcctttcttaaaagaaaatcgtgacaagatactttccttgctcacatttcgaattccttactacgttgggccattacaagactctaacaacaatcgtttttcttggatgacccgtaaagcaagtggtgcaataagaccttggaatttttctgagaaggtcaacgttgaacaatcttcaaatgatttcatcaaacggatgcgttcgaccgatacttatttgatcggcgagccagttctaccgaagaaaagcttgatctatcagtgctatgaggttctatctgaattgaacaacacccgtgtaaaggatggcagtagcaatcctaaacgcttagatgtcacaattaagcaacgcatttacaatgaaatatttaagaatcaaaaatcagtttcagttaaggtattgcaaaactggctgataaaagaaagctattttaaatcaccagaaatctctggtttagctgacaaaaagaagtatttatcatctctttcgacctacattgatttcaagaaaatttttggacagaggtttgttgatgaccccgtcaattcgccgcaattggaagaattagcagaatggttaacactctttgaagataagaagattctgttaatcaaattgcaaaactctaaatactcttatgatcaagccactatcaataaattatcgacgatgcggtatcaaggtactggaaaactttcaaaaaaattattagtagatttgaagactactaaaaagtcaattggcaaaagtggcgctgaatctctttccatactggatttgatgtggtcgactaaagataatttcatgcaaatcatccacgatgcagattatacttttgagcaacaaattaaagaattcaactatgatacggaagatgagctgacgcctttggaaaaagtggccaatttacatggctcacctgctttgaaacggggattgaatcaatcgatcaaggttgtcgcagacatcgtcaaatttatgggccacgatccagaaaaaatctttattgaattcactcgttctgatgacttcagcaagttgactatttctagataccgtcggatcaaaaagcagtatctagaaattgccaaggcaatcaaaaaaataccagcagaatttaaagacatcaaggaatatcaaactcaacttgaggaaaataaaggcaagttggcaagtgaaagactgatgctatacttcctgcaatgtggtcatagtttgtacagtaataagccgattgatttaaatatgatcaatagttctaagtatcatgtagatcatatcttgccacaatcttacattaaagatgactctcttgagaataaggctttggtcttagcttcagaaaatgaaaataagatcgacaacatgctgatcagtcatgacatcattgctactaacttaccacgctggcaggctttgaaagaccagaatttgatgggatccaaaaaatttgctgatttgacaagaacaaccgtgactgaaaaccagaaaaaaggatttattcaaagacagctagtccagacttcccaaatcgttaaaaatatcacactgattttaaatgatctttataaaaatactagctgtattgaaactcgagctactctctcaagcgaatttaggaaagcctttagtaatttcgacgaaactacttatcattatcaatttcctgaatttgttaaaaatcgagatgtcaatgattttcatcatgctcaagatgcttttctcgcttgtgttatcggtgaatatcaactaaaaaagtatcctaaagataatttacgattagtctatgaccaatattcaaagtttctcgattcactaaaaaaagacacccgcaaaaaaaatggacggatgccaagatacactcaaaatgggtttattattggatcaatgtttaacggtaagacctacgttgatgacaacggtgaaattatttgggatcaaaaaatcaaggagtccattcgtaagacctttaattatcatcaattcaatgtcgtcagacaaaccattgaacagcatggaaaacttttcaacgacactatccaaccacacagtgacaggtataaattgattccattgaagaccaatcgtgacccagctatttacggtggatacaataacgataacaatgcctattctgttgtgctggatgttgatggtaagaaaaaaataaacggcattcctattagaattgctaaccaactcaaatctgatgaacttgatctaagcagttggcttgaaaataatatcaaacacaaaaaaccaatgactattttaattgataaagtcccaaagtatcaacgaattatcaatgaagaaacaggtgacctattgattacttctgcaaacgaagtaatcaacaacgtacagttgttcctaccaagtatgtacaccgcattaatcagtttattagattcgacaaaaactgaaatgtattcaaaacttttaagtaactatgaagcaaacattttaatagatatttacgattatctactgactaaattgaaaaataactacccactttatcgaaaggagtgggccaaactagctgaacatcgtgatgactttattgaatctgatctggtaacgcaagccagtactctgcaacagttaatcaagtttatgcatgctgatccttcaaatgttaatttaaaatttggtaattttaaaggcaaccgttttggtcgtaaaaatggcaatattaaactgtcaaaaactgattttatttatgaatcaccaaccggattatttaaatcaattaaacatatcgactaa

SEQ ID NO: 356 - DNA, 4068 bp, Lactobacillus zymae DSM 19395
aagggatttattaatttgtacaaaaaatacggtattggattagatattggaaccagttcaattggctggtccgtggtggatgagtacggtcacatcatccgggtcaaagggcaaaccgggttaggtgttcggctttttcgggaggggcaacccgcagcggacagacgaaccttccggacgacgcggcgccgtttggggcggcgccggtggcggttacggttgctacgtgagatttttgacccatacattgccgcccaagatccaaacttttttgcgcggcaaaaggcgtctgcaattgccccgggcgattcgcgcttcaaggccgtttatcggctttttaacgaccaaaccgaccggcaattctacgataagtacccgaccgtctatcatttgcgccagaagttgatgaccgaaaaacgtcagtttgatatccgggagatttatttggccgttcaccacatcgtgaagtaccggggccactttttaactggtggtgccgcgaaaaactttaaaccagggaagctggatttaaacacctattttgcaacgattaacgcccaattagcggcaattttcatggattcacaggtggagcttccccaattggattgggatgcggtggtgtcattgttgaccaacgaccaggaatcgcccagtgaccggcagaaggcgttgactaaaatgctggtggctcagggtgatgcgacgcaaaaacggttctataccgagttttcgaaggccctgctggggttgaaagctaagctttacgttttaacgggattcgagggggataagactgaccaaaaggccttaacgttaagtttggagactttagatgaccatcaagatgatgttactcagttattgggggatgaacagcgtcagttggtagaattattggccagggtgcagtctgcaatccagcttgccattattattcccaacggcaagacgttctctggccagatggttcagcagtaccaaacgcattatgaccaattgcggctcttaaaagactatcgggaacaattaacggatcaaaaacaccggcgggccctgaaacaggcttacgccgactatctggcaaatgatcaagatcaggatgccctagtcaaggcggtagagaaagttttaaagcagaatcagccgcttagtaccgtgggcgtacggttacaaactgccattgacgcgggggactttctgcccaagcagcgaaccaaggcgaatagcgtgattccgcatcaaattcatcagcaagagttggaccgaattatcgaagctcagtccgtttattatccttggttagctgaggaaaatccggtggcagcccatcgcagctatgccccatataagttggacgaattagttgattttcgggttccatattacgtggggccactagtacagccgcaagcggataaagcggctaaggaaaccaagtttgcgtggatgacgcgcaaggaagcccagtcgaccacgcccatcacgccctggaactttgagcaagaggtggaccgtaacgcctcggcgaacgcattcattcaacggatgaagaccacggatacctacctattaggcgaggacgtgttaccaaaaaatagcctgttatatcaacgcttcgaggtattaaatgaattaaacaatgttcgcgtggacggtaagctattgacgattgccgaaaaacaacgactttttcaggacctatttgttgaccggtcacaagcgtcagtcaccatcgcgcaattacaagccaatctcatcgcgcacggtgccgctaaggaccgggtcgaaatcaaagggttggctgatcctaagcgtttcttgagcagtttaacaacgtatcacgattacgctcaaatcattccggaagccttggaacaaccggacaagcgtgccgatattgaaaaaatcatcaactggtcgaccatttttgaagatacgtcgatctttaaagaaaagctgcaggagattgcttggctcacaccagaccagcgccgccagttaagccaaaagcggtaccgcggttgggggcaactctctgataaattattaactcagctgcgcgatgcgacggggcagtccgtgatggatttactatggactgaaccgaataactttatgcagatcattcgtcgaacggaatttcagcaggcgattgcgagagtgaaccagaccgacctgaagcaacaggacttagcgacaacaatcaatgatctgtatacgtcaccgcaaaacaaaaaggcgattcgccaggtcttattagtggtcgccgatattcaaacggcgatgcacgaagtggcgcctagctggctattcatcgaagcggcacgcgggccggaacagaatcctaagcgtaagttagcccgccaacagcaactgctagaagcctataaaacgagtgctaaagaaattgttaacgaagccgttaaggaaaagttactgtcggcaattgacgaccatcaaaaattcgaggatcaggtagtcctgtacttccaacaaaatgggctcgatatgtatacggggaagccgttagactttgagcgcttgtcgaagtaccacattgaccacattattccccagtcggtggttaaggacgattcactggataatcgggtgctgaccacgccagaggaaaatgaacgaaagggtgcccgggtccccggaccgttgtacgcgagtcagcaaggccggtggcggttattgcaacgggccggcttgatttcccaacggaagttggaccacctactcttacggccggaggaattagaccaacaggctacgggctttgttgctcggcaattggtggagactcgtcaggtgattaagttgattaccaatattttgagccaacagtatgatccggaacaaacgaaattggtctcggtcaaagcgggattgtcgcatcaattccggaccaggttaaacctacccaagctacgggaactcaatgattatcaccatgcgcacgatgcctacttagcagcacgaattgggacctatttgttacaacggtaccccaatctagaacggttcttcgtttatgggcagtatcagaaaacacggtttgacttaaagcggcattttaactttattggggagatgttgaaaggcaagccagaggatgcggtgattgttaaggcaccacactcggagaccgttatttgggataagcaggatgaagtcaaacagctgaaaaaaataatggaatacaggcatttattagttactcatgaggtttatgataaccatggcgcactatttaatcaaaccattcatccggctaaaaatcctaaaaacagaaagttaattccgcgcaaaaccactcaatctacagaactgtatggtgggtatagtggtgaaacaaccggctatttagccatcgcacggacggttactaagaacaagataagctatcaagtattgcgggtcccgacgcgtttggtggggcgcctgcaacgaagtagtgagtccgcacaacgacagattctgacggactggtttgcacctagctttgtttcccggggtaaacaacagccgtttgaaattgtcttacgccatgtatttaaaaatcagacagtgattgatgatattcatgaacaatcacatcgttttggattgagatcagatacttattattgtaatcagcagcaactggttttgtcgctagaacagcaaagaatgataattgatcagaaattaaataatacgaataagttgatggtggtttatgaagctgtttgtgatcaagtggcgaaatattttccactttatcgaatgaatcactttaaggaaagtttgttagaggcgggcccgaaattagccgagttgccaattaataccgtacaatctaaaaacggaaaattgaaattagggcaaagaagtgtccttctacagacaatgcaaggattacatgctaatcctgagacaaaggatttgtccattattggatgccctaagtattttggaaagttgcaagtttcatcaggtattaagttaactgagaatgccgtgttaattcatgaatcaccaactggattattccaacgacgcgttcgtttaagtgattta

SEQ ID NO: 357 - DNA, 4068 bp, Leuconostoc gelidum JB7
atgacatattcaattggtttagatattggaacaggttctgttggatgggctgttattggggatgattatcgtttaaagcgtgctaaaggtaaaaacttaattggcgtacgactatttgactcagcaacaacagcagctgaaaggcgtggttatcgtacgacgcgtcgacgtttatcacgccgccattggcgtttgcgtttgttaaacgatatttttgcatcagatttagcagaacaggatgaaaattttttgccacgactcaaatattcatgggtcaacccagatgatgagcaaaatccgcagttgaatagcgatgttgcaaacggtgcgttgtttggatcaagcgagacagataaagcatttcacaaaaattatccaacgatttatcatttgcgacatgaacttatgacagatacggctaaacatgatttacgtgaagtttatttggcaattcatcatatcgtaaaatatcgtggtaattttttaaatacagcagataaaattaacgcagagaattcgttcaatgttgacctatttatagcagcgttagacgaatataatgaatttctagaaacacctattacatcaattaaggatgcgcaattattttcagataagctaactgacataaacgctcgtaacaaatctgtccgtgtagaaaatgcaatgtcagaaacttatgatgataaatctaaaatatttaaagctatattgacagcactagtaggtaatacagctaactttcaaactatttttgacttatctgatcttgaaaaagatgaagctaaaaatttcaaatttaaacttgacttagaagatgtcgagacaaaactagatgttgtgcgagcaaaactttcagatgaacaaaatgcttttctagaggctgttttaatagcgtatgatggtatcactttaaaaatgattttgggtgattataaaagtattagtcaatcaatgattgaaagttataagtcacatcaacgtgattggaagtatattaaaaataatgtgcgattaaacgagcaaaaaattgaaccagacaaaaatagtgttaaattttttaaattagatccaaaaaaattgatatatccatcaaatttggcttatttacaggtgatttcgtcaaatgaagatgagcatagaaagggtttggactattttaaaacagctattcaagatgcggatattttacaacgtattgagaatgatactttcttaccaagacaacgtacaaaacggaatggcgttttgccatatcaattacatttagcagagttagaacaaattattaaaaagcagagcaaatattatccatttttagctaacatatacacgcaagacaataaaacagaaaacaaattgatcgggttattgaaattcagagtaccatactatgtcgggccacttgttgaagcagaaaaagttacaggagatggtaaaaatcattggttaattaaaaaagaactgcaagaaaacacaccaattacaccctttaattttgatgacgttgtagataaagataaaagtggtgagcagtttatcaaacgcataactggtactgatagttatttaattggagaaccaacgttaccagaaaattctcttttgtatcaaaagtataacgtgttacaagagttgaacaatgtgcgcaatgaaagacatcaacggttaccgattaaagtgaaacaagatatatttgaacatgtttttaaaattgataaaaatgttaatgctaaaaaagtgatggcctatctcaaattaaatggatatggtgattttcaaatagctggtttatctgatacacgcacaggcaagtttaatagtaatttgtcaagctataattactttgttgacctactcggtcgcgaaaaaaccgaaaaaattagggaagatagattagaagaaattattgaaatacaaactgtgtttgaagataaaattctcgtcgctaaacgactatctaatctagactttttaacgcctcaagaaaaaagcaagctatcagcaaagcattacactgggtggggcaggctatcgcagaaattactcacaacgcaatttataaaaacggctctatctgaagcaggggatatcataccacagtcacacagtataatagacttgctctactatactgataaaaatttaatggaaattttgaatgataaaacattcaatgtacgaaattggctgacagaacagaataaaggaacagagtctggcaatagcctctatgatcaaattgatgctttggcaggtccaaaggatattaagcgtggtattacacaagtgtttagtattattgatgatattaaaaaagcaatgggtagcaatccagaaacagtgtatttggagttcgcccgtgaaacacaaacttcacgtttaacaaattctaggttaaatcgtgtgcaagaaatatacaacagtccagaattaaagactgaatttgcatatctagccaagaaattagaagctgaaacaaaagagtcaattcatgatgatagattatatctatattatctacaagaagggcgggatatgtacactggaaaagaaattccgtttgatcaaataagcagtaactatgatattgaccatattattccacaggcatttacgaaagatgattcacttgataatcgtgtactggtcaaccgtgcaacaaatgcgagaaagtctaactcgccaacctttacgaatgatattattgataaccggaaatcttggtggcaatcattggtcaaacgtggtttaatgtcaaaagaaaaatttgaacgtttgactgataagcgtaaaacctttagcgagaaccagacaaatcattttattgcccggcaattagttgaaacgcgccagattattaaaaatgttgctgacttgattaagaataactatgatggcactcaggcagtcgcaattcgagcatcattaactggtgaaatgcgccgttatttggattggccaaaaaatcgtgacatgaatgattatcatcatgcacatgacgcgttaatgatggcaactgttgggaagtatgttgataggcgtggcttttttgataatggcagtgtcagtgatggtgctggaaatgcctataacttatatactaaagattggttagtcgcagctcgtgtaggaactagaaatgatagtcaacgtgttaatccttatggttttattgttgggtcaatgaattcaaaagcagttcgacaacaggtaaataaagaaaccggcgaaatagtctggggtaatgaaaacttagattatttacgtcatgtgttgagttataaaaaaatattagttacacgacgattaagtggctcatctggccgattgtatgcggagacgttgttcagcccaaatcccaaagctaaattaattgcacaaaaagctaatcgttcggttgcattatatggtggtttcacaaaagctgaatctgcctatacggcgctggtggaatttaataagaaaggcgacaggtcgtacaagctgataaaggtgcctatggcaatagccaatcgtgttaatgataaacaaataactgtaacggcatacattgcatctttaaatttacgtgattttagtcgcgttgttcttgaacatttaccgctcggcactttgattcgagaatctgatggtagtgaattttatgcagctagttcagaatataaacataatgcgaaagaactttgggcgcctaaagaaattttgagaagttcaaaaaaattagataaagcaactgctgataatttaattgatatttttgattttttgaccaatgataaaacaatcagtaattttaaattttatgagaaagatttattacacttgaaaaatgttcgtgataaatttgttgaagcaagtgatgaaatcaagattaaagttttatcggatgttatttatgaattgcataatgatgctgggtggcgcgatccgtttaaacatattcaggagaaacctgcttggactatgttacaagtcaagggtgggatcaagttgtctgagaaagcggcaattgtatatcaatcacccacagggttatttgaaacaatcaccattgttggtgaataa

SEQ ID NO: 358 - DNA, 2676 bp, Leuconostoc pseudomesenteroides 4882
ctgaagcgcacaaaaggcaagaatttgattggggtacgcctgtttgaaggagctgatactgctgctgaacgacgtggttatcgtactacacgccgtcgtttatcacgtcgtcggtggcgtttgcgattgctgaatgatatttttgcatcggagttatctaaaattgatgaaaactttttgccacgcttaaaatatagttgggttaataaaaatgatactgataatgtacactttggtgtaggggtttttgataattctgaacaagaaaaggctttttatcaagattatccaacaatttatcatttgcgccaaaagctgatgacagacaatcgacaacatgacttgcgtgaagtttacttagcgattcaccatattgttaaatatcgtggccattttttgaattcaggtgaaattagtgcaaatagtagttttgatgcgcaaaaatttctggaattattgcgtgaatttgataatactttttatcccgatgctgttaagtttttaaacttagatcaattggatttaccagataaaatttcttctgaaatcagtgattcgaaaataagtaaaagtgaacgagttgacagggttttgcaacatgtacaattagcgaactctggtgcgaagaagatactgaaagccatattaaatgctgttgttggtaactcagttgacagtgttgctatgttttcgcttagtgatttggataaggaagaaaagaaaaaaatcaatcaccctgtaactgatagtaaaccctttaagtattctgataaagaggttgaggctaagttggatgagctctctaatttattacaagatgagcagaaaattgaattcttgtcgttgttgaaattatcttttgatggattaactttaaaaatgttacttggtaacgctaaatctgtgtctgaagcgatggttgaacgttataaagtgcacaaggacgatttaaaattcattaaggaaaatattttaaattcatttagtaaggataagaagaaagaatttgataaatactatgaggctcatttagcggaaaaagacgttgataatgttgataagtattttaagaaaataattgacgactcgataatttcaaaggataagaaaattgagttattgcagaaaattgatgatcatgattttttgccgtcacaacgaagcaaaattaatggggctattccgcatcaactacaccgtaatgaattagataaaattatttcgcaacaaagcaaatattatccatttttagccgattcgtatacacaaaatggtaaaactgaaacaaagctcgccggattggttaattttagagtgccatattatgttggtccactcgtttctaaagaaaatgctgatcgtaataatcctgacggtgggcaaaatcactgggtagaatttaaagaaaatactagtttatctaatctaacaccatggaattttaatgaaattgttgataaagataagtcagcagcgaagtttatcgagcgattgacaggaatggatacttacttaattggtgaaccgactttgccgcaaaactcgttgctatatcaaaagtataatgttttgcaggaacttaataacatccgtgtagataatcacaaattagatgtgaaaattaagcaagatgtttttgaacatttatttaaaacccaaaatagtgtttctgctaaggatgttaagaattatttaattgccaatggttacgctgcgccaagtatacaaatcacaggcttatcagatacgaatgaaaaaacttttaatagtaaattgtctagctacaattatttggttgataagctgggtagaacttttgttgagtcagtcaaatcagatgtcttggaaaaaatcattgaattgcaaactgtttttgaagataagactgtactgttaagacaattatcaatgatttcagaattaacattggcgcaagcaaatcaattagctgaaaaacactggaccggctggggacggctatctcgcaagttgttatcttcaaaagtagttgatgttaataaaatcacaaattcgacattttatcctgcaacaagtagacaaactatcatcgacacactgtatcatacacaacttaacttaatggaaatcattaataatgcagaggacttatatggtgttcgtcagtggattagtgaacaaaataaaagtgatagttcagatactaatgatgtctatgatcaaattcaagaactagctggagataaaaagattaagcgtggtattacgcaaagttttcgaatacttgatgatattgttaaggcgatgggtggggaacctgaacgggtttatttagaatttgccagagaaaatcaacaatctggtgtatctttttctaggaaaaatttactgtcaaaattatacgaaaatgattctctaaaacaaacattcaaagaacttaaatctcaacttgagagtgaaaccaaagaaaatctacaaaatgatcgcctatatttgtattatttgcaacagggacgagacatgtattccaatgatgagttaaatattgatcagttatctagctatgatattgatcacattattcctcaagcttacaccaaagacaattcgtttgataatcgtgttttagtttcatcaaaagcaaatcgcctaaaacgaatgcttctgtggtacccagtgaagttgtcgaaaaaatga

SEQ ID NO: 359 - DNA, 4179 bp, Oenococcus kitaharae DSM 17330
atggtttttatggcacgggattattcagttgggttggatattggaacgagttctgttggctgggcggcgattgacaataaatatcacttgattcgagcaaaaagtaagaatttgatcggagtcaggctttttgattctgccgttactgcagaaaaaagacgaggctatcgtacgacacgtcggcgattgtcacgcaggcactggcgtttaaggctattgaacgacatatttgcagggccactgacagatttcggggatgaaaattttcttgcacgtctcaaatattcttgggttcatccacaggaccaatcaaaccaggctcattttgccgccggactcttgttcgattccaaagaacaggataaagatttttataggaaatatcccacaatctaccatttacgattggcattgatgaatgatgaccaaaagcatgatctcagagaagtctatttagcgattcatcatctagtcaaatatcgtggtcactttctcatcgaaggcgatgtgaaagcagattctgcttttgacgtacacacttttgcagatgctattcagagatatgccgagtcaaataattcggacgaaaatttacttggtaaaattgatgaaaagaagttgtctgctgcattaactgataaacatggttcgaagtctcaacgcgcagaaacagcagaaactgcttttgacattttagatctacaaagcaaaaaacaaattcaggcaattttaaaatctgtcgttggtaatcaagctaatttgatggcgatatttggcttggattcatcagctatttccaaagatgaacaaaaaaattacaaattctcttttgatgatgctgatattgatgagaaaattgcagatagtgaagcattgctgtcagatactgaatttgagtttctttgtgatttaaaggcggcttttgatggtttgaccttgaaaatgcttctaggcgatgataaaacggtcagtgccgcgatggttcgccgctttaatgaacatcaaaaagattgggaatacataaaatctcatattcgtaatgcaaaaaatgccggcaatggtctctatgagaaaagcaaaaaatttgatggtatcaacgcagcctacttggctttacaaagcgataacgaggatgatcgcaaaaaggccaaaaaaatttttcaagatgaaataagttctgccgacattccggatgatgtaaaagctgattttcttaaaaaaattgatgatgatcaattcttaccaattcaaagaacaaaaaataatggtacgattcctcatcagcttcaccgtaatgaactggaacaaattattgaaaaacaaggtatttattatccatttttgaaggatacatatcaggaaaatagtcatgaactgaataaaataacggctctaattaattttcgtgtgccgtattatgtcggccccttggtagaggaagaacaaaaaattgcagatgatggaaaaaatattcccgatccaaccaatcattggatggtaagaaagtccaatgatacgattacgccatggaatttaagtcaagtcgtagatttggataaatcaggcaggcgatttattgagagattgacgggtacggatacatatttgataggcgaacccacattaccaaaaaattcgcttttgtatcagaaatttgatgttctacaggaactaaacaatatccgagtatccggccgccgtttggacattagggcaaaacaagacgcattcgaacatctttttaaggtacaaaaaacagtctcagcaacgaacttgaaggattttttggttcaggccggttatatttcagaagatactcaaattgaaggattggctgatgtaaatgggaagaattttaataatgcactaacaacctataattatcttgtttcggttttaggaagagaatttgttgaaaatcctagcaatgaagaattgttggaagaaataacagaattacaaaccgtttttgaagataaaaaagtcttgcgcaggcagcttgaccagttagatggcctttccgatcataatcgagaaaaactgtcaagaaagcattacaccggttggggacggatttcaaagaaacttttaaccacaaaaattgttcaaaatgctgataaaattgataatcagacttttgatgttccccgtatgaaccaaagtatcattgatactctgtacaatacaaaaatgaatttgatggagattattaataacgcggaggatgattttggcgttcgggcctggattgataaacagaatacgacggatggggatgagcaagatgtttacagtctcattgatgagttagctggtccaaaggaaataaaacgtggtattgttcagtcctttcgaatcctggatgacatcacaaaagctgttggctatgctccgaaacgtgtttacctagaatttgcaagaaaaacacaagaatcacatctaactaattctcgaaaaaatcagctaagcacattattaaaaaatgccgggctgtcggaacttgtgactcaggtgagccaatatgatgctgccgctttgcaaaacgaccgcctatatttgtactttttgcagcaaggcaaagatatgtactctggcgaaaagttgaatttagataatctttcaaattacgatattgatcatattattccgcaagcctacacgaaagataattctttagacaaccgtgtgcttgtcagcaatattactaacaggcgcaaatctgattcgtcaaattatttgccagctttaatcgataaaatgcgcccattctggtctgtgctttcaaagcagggcctattgagtaaacacaaattcgctaatctgactcggacacgtgattttgatgatatggagaaagagcgttttattgcacgttcgctggtagaaacacgccaaattatcaaaaatgttgccagcttgattgattcgcattttggcggtgaaacaaaagccgttgccattcgttcatcattaacggctgacatgcggcgttatgtcgatattcctaaaaaccgtgatattaatgattatcaccacgcgtttgatgccttacttttttcaactgtcggtcaatatacagaaaatagcggactaatgaaaaaaggtcagctttcagacagtgcgggaaaccaatataatcgttatatcaaagagtggattcatgctgctcgtttaaatgctcagtcgcaaagagttaatccatttggttttgttgttgggtctatgcggaatgctgctcccggaaaattgaatccagaaactggtgagattacgccagaggagaatgctgattggtccattgctgatttggattatctgcataaagtgatgaattttagaaaaataactgtgactcgcaggttaaaagaccaaaagggccaattatatgatgaaagtcgttatccatccgttttgcatgatgccaaaagcaaagcatccatcaactttgataaacacaagcccgtagatctatacggtggatttagttcagctaaaccggcctatgctgcattaattaaatttaaaaataagtttcgattggtcaatgtgctgcggcaatggacttattctgataagaattctgaagattacattttggaacagattcgtggaaaatatcctaaggctgagatggtcttgtcacatataccatatggccagttggtaaaaaaagatggtgctttagttactatctcatcagcgactgaattgcataatttcgaacagctatggctgcctttggctgactataaattaattaacactctcttgaaaacaaaagaggataatctcgttgatattttgcataaccgcttagacttgcctgaaatgactattgaatcagctttttacaaagcttttgattcgatcttatcttttgctttcaataggtatgctttgcatcaaaatgcattggtaaagttacaagcacatcgtgatgactttaatgctttaaattatgaagataaacagcagactctggagaggattttggatgccctgcatgcgagcccggcttcttcggacttgaagaaaatcaatttatcgagtggattcgggagattattttctccctcgcatttcacattggcagatactgatgaattcatattccagtctgtcactggtttattttctactcaaaaaactgttgcacagttgtatcaagagacaaaataa

SEQ ID NO: 360 - DNA, 4137 bp, Pediococcus inopinatus DSM 20285
atgaaaaataaggactatagtatcggattagatattggaacgagttcaattggctttgcggtggtcgatgaaaataaccatgtcatgcgcgtaaaaggtaaaaatgcgattggggtgcgtctatttgatgagggaaagccggctgccgatcgacgtgcttttcgaactacacggcgtcgcctgagtcgccgtcgctggcgcttaaagttattacgtgaaatctttgattcgtacataactcccgtggatgaagcattctttattcggttaaaagaatctaatttatctcctaaagatagtaaaaaacaatattcaggggatatcttatttaatgatcgttcggataaggatttttatacaaaatacccaacaatctatcatttgcgtaatgcattgatgaccgaacatcaaagatttgacattcgtgaaatttatttggcaattcaccatattgtcaagtttcgaggccactttttaaatgccacgcctgctaataattttcaagtgggtaagcttgatttggaccaaaaattcgaagatttaaatgatatatatcaacgtgttttccctgacgattcaattgaatttcgaatagataatttagagcaaattaaagcagttttgttggacagcaaacgaagccgatctgatcgacaacgatccttagttgacgatgtttatcaaacgtctgaagacaaagaagttgagaagcaaaataaggctgttgcaactgaagtattaaaagccattcttggaaataaggcaaagctaaatataattgctaatgtagaagtggacaaagaagctgcaaaagaatggacgatcacgtttgattctgaaagcatagatgatgatttagctaagattgatggacaaatgacggatgacgggcgcgcaattgttgagattctgcgtagtttatactctggaatcacattatctgcaattgttcctgaaaatcatacattatcacaagcaatggttgcaaaatatgacctgcataagaaacatttgacactgctaaaaaaattaattaatagtatgacagataccaagaaagccaagaatcttcgtgcagcatacgatgggtatgttgatggtgtgaaaggtaaagttttaacccaggatgagttttataaacaaattcaatctaatttggatgagtctgtggaagctagtgaaattcaaacttatattgatcaagatatttttatgccaaagcaacgaaccaaggcaaatggctcgatcccgcatcagttacaacaacaagagttagatcagattatcgaaaatcaaaaagagtattatccttggttagcagaattgaatcctaatcctgataagaaacggcaacagcttgccaaatataaactagatgagttagttacatttagagtgccatattatgttggtcccatgattactgcagaggctcaaaagaaacaatcaggtgctgaatttgcctggatgattcgtaaagagagtggcaatattacgccatggaactttgatcaaaaagtcgaccgtatggcaacggccaatcaatttattaaacggatgactacgacggatacttatttgttgggtgaagatgtattgccatcacaaagtttgttatatcaaagatttgaagtcttgaatgaattgaacaaaattcgaattgatcgcaaaccaatttctgttgaattgaaacaacaaattttcaatgatttgtttaaaaagtttaagaacgtgacaatcaagcatcttcaagattatcttgttgcacaaggacagtattctaaacgaccgcttattgaaggcttagcagacgaaaaacgattcaatagcgggttaagtacctataatgatttctgtggcatttttggtgcgaaattagttgatgaaaatgatcgacaagcagacttagaaaaaattattgaatggtcaacaatttttgaagataagaaaatttaccgtgctaaattaaatgatctggcctggttgacagacgagcaaaaagataaattagcaactaagcgttatcaaggatggggcagactatcaagcaagctattaataggcttacaaaattctgagcatcgcaacattatggatcttctctggattggtaatgaaaacttcatgcaaattcaggctgattcagattttgctaagttaattaaggatgctaatcaaaacgcactccaaaataatgattcacaggatgtcattaatgatctttacacatctccacagaataaaaaggctattcgccaaatcttgttagtcgttcatgatattcagaacgctatgcatggccaggcacctactaagattcatgtggaatttgcgaaaggagaagagcgcaatccacgtagatctgtacagcgtcaaagacaagttgaagcggcttatgagaaagcgtcaaatgagttagtaggcgctaatgttagagaagaactgaaagatgcgattactaataaacgtgatttcaaagatcgtttattcctttacttcatgcagggcggagtagatatgtatagtggagaaccaatcaacattgataatctttcacgctacgacattgatcatattcttcctcaagcttttgttaaggatgattcgttaaataatcgtgttttgacggatgcagaaaagaatcgacgtaagtcagatgctgttcctaatgagctttttggtgcgaagatgcgtgtaacttgggaaagaatgaaggaacaaggattaatatcaaaaggcaaatatcgaaatttgactatgaatcccgaaaatattaacaagtataccgaaaatggctttattaatcgtcaattggtggagacacgtcaggttataaaattagccgtgaatattttggctgatgagtataaagaaaatacgcaaatcatttctgtcaaggccgatttgtctcatcaaatgcgtgaagattttgaattgttaaagaatcgtgatgtaaatgattatcatcatgcttttgatgcctatttggcagcgtttatggggaattatcttctgaaacgttatccaaaattgaggtcatactttgtttacggtgattttaagaagtttacacaaaaggaaataaagctaagacgctttaactttatctatgacttgaaacatgaagaccaagtaatcgataaagaaactggagaaatattatggaataaaaacgaagatattgcatatattcgtcatttatttgcgtataaaaagattcttatttctcatgaggttagtgaacgtcgcggggctttatataatcagacagtttataaagctagtgacgataaagccagcggacaaggaagcaagaaattaatccctataaaatctgataaacctactgaaatatatggtgggtacacggggagaacgttagcttatatgactatagtgaaagttacaaaaggtaaaaaaattagttataaagttgtgggggttccgaccgctgttttggccaagatggctggcgtaaggcaaggctcacaagaagaacaagacaaattgtatggtgttttgaagccacaatttacgcatcaaaaggaaaataagaaaaccggtgaaattactgagacagtggataaatttgatattattgtgccaaaagttaagtatcaacagctggttaatgataatggacaattatttatgattggaagtgatacacttccctataacgctgaacaacttgtcttatcaaaagaatcagtacaaactatcaataatccaggtatcaaagatgaaggtagtgatgaagaatcagaaaataaaaaattggataatgtatacgatgagattgttttatgtatgaataaatattttccgttatatgacaatagagggttcagaaatagtataacaaatgggaaaaacaagtttttaaaattgccaatcaaaaacatttataaaaatggcaaattaataaatgttgggaaaagagaagttattaatagaatcttacagggactacatgccaatgcttcagttacagatttgtcaaatttgggaattaaatctccatttggatttctacaaaaaggagctggtctttctcttagtggagaggcccagcttatccatcagtcggcaaccggattatttgaacatcgggttcaactaaacaaaattaagtaa

SEQ ID NO: 361 - DNA, 4125 bp, Pediococcus lolii DSM 19927
tcgggggaaaaacgatatagtgagattaataacgttgaggaggaattttatatgggtgacagaaagtataaccttggtctcgatatcgggacgtcatcaattggctttgcggcagttgacgaaaataaccaacccattcgagtcaaaggaaagacggcaattggggtacgtctctttgaagagggcaaaacggcggcggatcggcgtggttttcggactacgcggcggagattatcccggcgccggtggcggatcaatttattgaacggaatttttgatgcgcaccttgccgaggtggaccccacctttttggcccggttaaaagaatcgaaccggtcaaatttggatccaaagaagtcttttcaaggctcacttttattcccagaacggaaagattatcaattctacaaggaatatcccacgatttaccatttgcgaaaggcattgatggaaaaagaccggaagtttgatattcgggaaatttatttagcagtccatcacattattaaatatcggggaaacttcttaaacggaacgccgatgcggtcgtttaaagtagaaaatattgagcttgatacgttatttgaccggttaaaccagctttatgaagagattattcccgacaatgaactggcctttgatttagaacaagtggcggatgttaaggaagttcttagtagcacaactatctataaaatggataagaaaaaacaactagtgaagatgatgctgcttcccgcaagcaacaaggcattacagagtgaaaacaagaaaatcgttacgcagtttgttaatgcgattttgaactataagtttaagcttgacgtgctcctccaagttgaaacggacgcggattggtccttgaagttaaacgacgagggggcggatgataaattagaagaattcacgggtgatttagatgaaaatcgtttggaaattattgatcttttgcaaagactacataactggttttcattaaatgaaattacaaaagatggtaattcgttgtccgcggcgatggttgaaaaatataaagaccaccgtcaccatttagaattattgaaaaaggtaattgaggatcattcagatgccaagaaagcaaaagcactgaaggaaacgtacacggcctacgtcggtaaaacggacgataagacccagaacaaagatgatttctataaggctgtggaaaagaacttagatgattcgccggaagcaaaagaaattaaacgtttaattcagctagaccagttcatgcctaagcaacggactgggcaaaatggggcaatccctcaccaactgcatcaacaggagctcgaccaaattatcgaaaagcaatctaaatattatccgtttttggcggagccgaatccgaacgttaagcgccgtaaagatgctccttacaaactagacgaattgattgcctttaagatcccgtactacgtgggcccattggtaacgccggaagaacaagcacaaaataaagaaaacgtgtttgcgtggatgaagcggaaggctgccggtccaattacaccatggaattttgatgaaaaagttgaccggatggaatccgcaaaccgatttattcggcggatgactaccaaagatacgtatctttttggcgaagatgtcttacctgcggaaagcatgatttacgaaaaatttgtggtgcttaatgagctaaataatttgaaaattaatgggcggcatttatcgcttaaggataagcaagacatttataatgacttgttcaagcaacaaaaaacggtttccattaaagcgctccaaaattactacgttaccaaaaagaaggctgcaaccgcgcctaccgtgggcggattggccgatccaaagaaatttttatcaagtctatcaacttatattgatttcaaaaatatgtttggggagcgggtaaacgatccgcaattccaagaggatttggaacaaatcgtggaatggtcgacaatttttgaagatcggggaatcttcaaggcaaaattacaagccctgggttggctatctgaaaagcagattcaacaactggtggctaaacgttacaaaggatggggccggctttccaagaagctcttaactgggctaaagaacgcggaaggatactcaattttagacgaaatgtggcattcgaccgaaaacttcatgcaaattcaaactcgcccagaatttgcggcactaattcaacaggccaacgaaaagcaatttgagggcaacgacccggataatgtttgggagaatattgaaaacattttgggggatgcgtacacttcaccacaaaataagaaggcaatccgtcaagtggtgaaggttgtccaagatattgaaaaagcagtgggtaacccacctgaaaaaattgcgattgagtttacccgtgaagccgcggcgaaccctcaacggacgcaaagccgtttgcggaccttggaaaaactttatgaaagtgccgaagaagttgtagacgcggggttaactgccgaactagctgaatttaaggaaaataagcacgttttatcggataagtactacctgtactttacccaattaggccgggatgtttatactggggacactattagtctagataggttgaacgattacgatgttgaccacattttgccacaatcctttattaaggatgatagtttggacaaccgggtattgacgattcgagcggttaacaacggaaaaagtgataacgtaccagctaaaatgtttggcaaaaaaatgggttcgttttggcggtacttgctggataacgggatgatttccaaacgaaaatataataacttaattaccgatccggataatatcagtaaatacgcccaaaagggatttattaaccggcaactcgtggaaaccagtcaagttatcaaactgacggctaacattttaaacgggatttacgataaggacaccgaaattatcgaagttccagcgaaaatgaattctcaaatgcggaaaatgtttgatttggttaaggtgcgggaagttaacgactaccaccatgcctttgacgcttatttaactatctttattggaaactatctgtataaatgttatccaaaattacggccatactttgtttatgataattttaaaaagtttggtaacaaggaagatataggacataaacgttttaactttttaggaaaaattgagcgagacaagaaagtggttgctcctgaaactggtgaaatcttgtggtcaaacgtggcaccgaatgagaccatcaagcagattaagaaggtttatgattataaatttatgcttacttctcatgaaacttacactaaacacggtgcgttgtttaatcaaacgatatactctgccaaagcttcaaaaacgatgattccaattaaaaatgaccgacctaccaaactttacggtgggtatagcgggaatgaagatgcatatatgagcattattaggttaagtgacaagaaaaaaacgtacaaagtagttggtatatcaatgcgcgatgctagtaagttgaaagcttatgaaaataatgcgcatgaagaatatctaaaaaaattaaaggaagttattgaacagcaatttttagatagtggcaaaaaaactaaagccgattttgaaattgttattccaaaagttaattatcatcaaagaatgcaggatggcacaaagcaatttagaattggcagttccaaatatgtacacaacactaagcagttagtattatctgagaaaactctaaaagccattcgaaacaataagcaatataacggagatgctgaaaaggatcttattaatgcttttgatgaaatactaactattgttaatgattcgttcagtatttttgatattagaagttttagaaaaaagcttaatgaaagtcgagataagtttgtttctttaccagtagaagatacaaaagaaaaaagcaaagttattaaaggcaagcgggagacgttgaagcagatattgattgcacttcatgcaaacggcacttcacaagacatcccacaactagggcttaaaagttttggaaaaatggttaaaactggggggcttacattatcagaaaatacagccctaattcatcaatcgccatcaggattattcgaacataaaattaaattaagcgatctttaa

SEQ ID NO: 362 - DNA, 4074 bp, Pediococcus parvulus DSM 20332A
atgggtgacagaaagtataaccttggtctcgatatcgggacgtcatcaattggctttgcggcagttgacgaaaataaccaacccattcgagtcaaaggaaagacggcaattggggtacgtctctttgaagagggcaaaacggcggcggatcggcgtggttttcggactacgcggcggagattatcccggcgccggtggcggatcaatttattgaacggaatttttgatgcgcaccttgccgaggtggaccccacctttttggcccggttaaaagaatcgaaccggtcaaatttggatccaaagaagtcttttcaaggctcacttttattcccagaacggaaagattatcaattctacaaggaatatcccacgatttaccatttgcgaaaggcattgatggaaaaagaccggaagtttgatattcgggaaatttatttagcagtccatcacattattaaatatcggggaaacttcttaaacggaacgccgatgcggtcgtttaaagtagaaaatattgagcttgatacgttatttgaccggttaaaccagctttatgaagagattattcccgacaatgaactggcctttgatttagaacaagtggcggatgttaaggaagttcttagtagcacaactatctataaaatggataagaaaaaacaactagtgaagatgatgctgcttcccgcaagcaacaaggcattacagagtgaaaacaagaaaatcgttacgcagtttgttaatgcgattttgaactataagtttaagcttgacgtgctcctccaagttgaaacggacgcggattggtccttgaagttaaacgacgagggggcggatgataaattagaagaattcacgggtgatttagatgaaaatcgtttggaaattattgatcttttgcaaagactacataactggttttcattaaatgaaattacaaaagatggtaattcgttgtccgcggcgatggttgaaaaatataaagaccaccgtcaccatttagaattattgaaaaaggtaattgaggatcattcagatgccaagaaagcaaaagcactgaaggaaacgtacacggcctacgtcggtaaaacggacgataagacccagaacaaagatgatttctataaggctgtggaaaagaacttagatgattcgccggaagcaaaagaaattaaacgtttaattcagctagaccagttcatgcctaagcaacggactgggcaaaatggggcaatccctcaccaactgcatcaacaggagctcgaccaaattatcgaaaagcaatctaaatattatccgtttttggcggagccgaatccgaacgttaagcgccgtaaagatgctccttacaaactagacgaattgattgcctttaagatcccgtactacgtgggcccattggtaacgccggaagaacaagcacaaaataaagaaaacgtgtttgcgtggatgaagcggaaggctgccggtccaattacaccatggaattttgatgaaaaagttgaccggatggaatccgcaaaccgatttattcggcggatgactaccaaagatacgtatctttttggcgaagatgtcttacctgcggaaagcatgatttacgaaaaatttgtggtgcttaatgagctaaataatttgaaaattaatgggcggcatttatcgcttaaggataagcaagacatttataatgacttgttcaagcaacaaaaaacggtttccattaaagcgctccaaaattactacgttaccaaaaagaaggctgcaaccgcgcctaccgtgggcggattggccgatccaaagaaatttttatcaagtctatcaacttatattgatttcaaaaatatgtttggggagcgggtaaacgatccgcaattccaagaggatttggaacaaatcgtggaatggtcgacaatttttgaagatcggggaatcttcaaggcaaaattacaagccctgggttggctatctgaaaagcagattcaacaactggtggctaaacgttacaaaggatggggccggctttccaagaagctcttaactgggctaaagaacgcggaaggatactcaattttagacgaaatgtggcattcgaccgaaaacttcatgcaaattcaaactcgcccagaatttgcggcactaattcaacaggccaacgaaaagcaatttgagggcaacgacccggataatgtttgggagaatattgaaaacattttgggggatgcgtacacttcaccacaaaataagaaggcaatccgtcaagtggtgaaggttgtccaagatattgaaaaagcagtgggtaacccacctgaaaaaattgcgattgagtttacccgtgaagccgcggcgaaccctcaacggacgcaaagccgtttgcggaccttggaaaaactttatgaaagtgccgaagaagttgtagacgcggggttaactgccgaactagctgaatttaaggaaaataagcacgttttatcggataagtactacctgtactttacccaattaggccgggatgtttatactggggacactattagtctagataggttgaacgattacgatgttgaccacattttgccacaatcctttattaaggatgatagtttggacaaccgggtattgacgattcgagcggttaacaacggaaaaagtgataacgtaccagctaaaatgtttggcaaaaaaatgggttcgttttggcggtacttgctggataacgggatgatttccaaacgaaaatataataacttaattaccgatccggataatatcagtaaatacgcccaaaagggatttattaaccggcaactcgtggaaaccagtcaagttatcaaactgacggctaacattttaaacgggatttacgataaggacaccgaaattatcgaagttccagcgaaaatgaattctcaaatgcggaaaatgtttgatttggttaaggtgcgggaagttaacgactaccaccatgcctttgacgcttatttaactatctttattggaaactatctgtataaatgttatccaaaattacggccatactttgtttatgataattttaaaaagtttggtaacaaggaagatataggacataaacgttttaactttttaggaaaaattgagcgagacaagaaagtggttgctcctgaaactggtgaaatcttgtggtcaaacgtggcaccgaatgagaccatcaagcagattaagaaggtttatgattataaatttatgcttacttctcatgaaacttacactaaacacggtgcgttgtttaatcaaacgatatactctgccaaagcttcaaaaacgatgattccaattaaaaatgaccgacctaccaaactttacggtgggtatagcgggaatgaagatgcatatatgagcattattaggttaagtgacaagaaaaaaacgtacaaagtagttggtatatcaatgcgcgatgctagtaagttgaaagcttatgaaaataatgcgcatgaagaatatctaaaaaaattaaaggaagttattgaacagcaatttttagatagtggcaaaaaaactaaagccgattttgaaattgttattccaaaagttaattatcatcaaagaatgcaggatggcacaaagcaatttagaattggcagttccaaatatgtacacaacactaagcagttagtattatctgagaaaactctaaaagccattcgaaacaataagcaatataacggagatgctgaaaaggatcttattaatgcttttgatgaaatactaactattgttaatgattcgttcagtatttttgatattagaagttttagaaaaaagcttaatgaaagtcgagataagtttgtttctttaccagtagaagatacaaaagaaaaaagcaaagttattaaaggcaagcgggagacgttgaagcagatattgattgcacttcatgcaaacggcacttcacaagacatcccacaactagggcttaaaagttttggaaaaatggttaaaactggggggcttacattatcagaaaatacagccctaattcatcaatcgccatcaggattattcgaacataaaattaaattaagcgatctttaa

SEQ ID NO: 363 - DNA, 4128 bp, Pediococcus parvulus DSM 20332B
atggaaaataagaaatatagtatcggcctagatatcggaaccagttcaattggttttgcagtcgtggatgaaaataaccgtgtcatgcgcgtgaaaggaaaaaatgcaattggtgtgcgtttattttctgaagggcaaccagctgcggatcgacgtagtttcagaacaacacgccgtcgcttaagtcgccgtcgttggcgtttacgattattgcgggagatttttgaaccgtacataaatcctgtggatgaagcattctttatgcgattgaaagaatcaaatttgtcaccgaaggatgctaacaagcactactcaggagatattttgtttaacgatcaatcggatcaaaaattttatgaaaagtatcctacaatctatcatttacgtcatgcgctcatgacagaacatcgtaaatttgatgttcgtgagatttatttggcgatccatcatattgtgaagtttcgtgggcattttttaaatgcagcttctgccagtaattttactgttggtaaattgaatttggagggcaaatttgatgctctaaatgaaatttatcaacgcgttttaactgatgatccgtttgcacttagaacggataatttggatcatatcaaagaaatattgattgataacaagcggagtaaggctgatcggcaacgaactttgactggggatgtgtatcaaagttctgaagaaaaagaaattgaaaaacgtaacaaagccattgcaaccgaaatcctgaaagctgcagttggtaataaagccaaattaaatgtgattaccaacgttgaagttgacaaggaagccgctaaagattggtccttaacatttgattcagaaacgattgatgatgaattggccaaggttgatggtcagatgacagacgatggccgtgaaattattgaaattttgcgtagtctatactccgggatcactttggcggcaattgtgccagaaaatcatactttatcacaatcaatggtagaaaaatataattcgcataaggcacatttgaaattattgaaagatttgattaataatatgactgatacgaggaaagctaagaatcttcgtgctgcatatgacggctatattgatggtgtaaagggaaaagttttaactagggatgatttctataaacaaattcaaggtaacttggatgattcagccgaagcacagaaaattcaagatgtgatggatcaagatgaatttatgcctaagcaacgcaccaaagcgaatggttcaattccgcatcaactgcaacaacaggagctggatcagatcgttgaaaatcaaaaggaatactatccttggttagctgaggaaaatccaaatgagacacgccgcggggttgctaaatataagttggatgagttggtcactttccgtgtgccttattatgttggcccaatgattactgccgaagatcaggaaaaacagtctggtgctagttttgcatggatgaaacgaaaagaaccaggaaatattacaccttggaacttcgatcaaaaagtggaccggatggctagtgcaaaccagtttatcaaacggatgacaactactgatacctatttattgggtgaagatgtgctaccggcacagagtttgttatatcaaagatttgaagtgttaaacgaactcaataaaattcgaattgatcgtaagccaatttcgatcgaactcaagcaacagatttttaatgatttgtttaaaaagtttaaaaatgtcacgattaagcatttgcaggagtatttagtagctactggtggctatgataaacgcccgagaattgacggtttagctgatgaaaaacgatttaatagtggactaagtgcttatcatgatttgcatggaattttgggtgcagaggttgttgatgccaatgataaacaagacgatttggaaaagattattgagtggtcgacaatttttgaagataaaaagatttaccgggccaaactagatgagttgacttggctaacggatagtcaaaaagaaaaattagcgactaaacgttatcaaggttggggtcgcttatcaaagaaactacttagtggtctaagaaactcggatcatcgtagtattttagacattttgtggattacgaacgaaaactttatgcaaattcaagcagatccagatttcgctgaacttgtaaaaaatgctaatcaagggatgcttggcaagaataattcacaggatgttattaacgatttatatacttctccacaaaacaaaaaagcaattcgacaaattttattagttgttcatgatatccaaaacgcgatgcatgggcaagcacccgctaaaattcatgtagaatttgcgcgtggagaggaacgtaaccctcgacgttccattcaacgtcagcatcagattgaagcagcatatgataaagtgaccagtgacctcttggtagacgccggtgttcgtcaagagctaaaagatgccattaacgataaacgagattttaaagatcgattattcctgtacttcatgcagggaggtcgtgatatttataatggcgaaccaattaatatagatcgcctttcaagctatgatattgatcatattttgccacaggcctttgttaaggatgattcattaaataatcgtgtgttaactgatgctgagggaaacagacgaaaatcggatgccgttcctagtgagctttttggtgctaagatgcgatcaacctgggaattaatgagagaacaggggttaatttcaaaagctaagtatcgaaatttaaccatgaatcctgagaatattaatgcccatactgaaaatggctttatcaatcggcaattggttgaaactcgacaggtaattaagttagctgttaatattttggctgatgaatatacagaagatacccaaattgtttcagtaaaggcggacctttcccatcagatgcgtgaagactttgaattactgaaaaatcgggatgtgaatgattatcaccatgcgtttgatgcctatttagcggcgtttattggcaactacttgttggaacgttatcctaagttgcagtcatactttgtttatggagatttcaagaagtttagtcaaaaagatacaaagatgagacggtttaactttatctacgatttgaaacatagtgatcagattgcagataagaatggtaaaaaaatatggcacaaaacgaatgatcttgattacattcgtcacttgtttgcatacaaaaagattctgatttcgcatgaagtgagtgaacggcgtggggcactttataatcaaaccgtgtataaagccagtgatgataaggctagtggacaaggttctaagaaattaatcccaattaaagctaataaaccgaccgaaatttatggtggatatactggtaaaacacttgcctacatggcgattgttaaagtgatcaagggtaagaaaattgcatataaagttgtgggggtaccgacttctgctttagttcaattagcaggtattgaacatggatctcaagaggaactaaatcggttatatgacgtacttaaacctcaatttacccaactgaagaaaaacaacaaaactggtgagatttctgaaactgtaagtaaatttgaaatcgttattcctagggtgaagtaccagcagttagtcgaagacgatgataaattgtttatgatcgggagtgatacgtacccgtataatgcacaacaattagtgttgtcagaaggtgcacttaaagtgataaataatgtttatcgaaagggagaaaacagtgataaacaagaaagttataaattggacgatgtgtatgatgaaattataattgccatgaaaaaatattttccactatatgataatcgtggctttagagaaaaagttgcggaaggtaaatcaacatttgaaaatttaccaatatcaaatgaatttaagaatggaaaactaactaaaatagggaaaaaagaggttatcaacaggatgttacagggattacacgctaatgcaacaatgacagatttgaagattttaggtattaaatctccatttggatttatgcaacagccaacaggtattgcattaagtgagaatgctcaactaatttatcagtcgccaacagatttatttgaacggcgagtacaattgaataaaattaagtaa

SEQ ID NO: 364 - DNA, 4146 bp, Pediococcus stilesii DSM 18001
tccgatatagtgagaattgataacggattggaggaattaaaagtgaacaacagaatttataacattggtctcgatatcgggacatcgtcggtcggttttgccgttacagatgctcaagacaaattggttcgagtgaaggggaaaacggcaattggcgtacgtctttttgaagaaggacataccgcagctgaacgccgtggatttcgaacaactcggcggagactatcacgccgaaaatggcggattaatttgttaaaccaaatttttgagccatacatatcagagattgatccaactttttttgcgcgtttaaagaattcaagtttagcgggaaaagataaaaaattcgaaggatcattattatttccggatcgaacggactatcagttttataaagataacccaacaatgtatcatttacgcaagcacttaatggagaaagatcgtcaatttgatctacgtgaaatttatttagcgatgcatcatataattaaatatcgggggaattttctgaatacgaccccaatgaatcattttaaaaatgaagaaattgactttagtgcacttttttcaagactaaacgaattgtatcaggaaattgacgatgaaaatatttttgaactgaacattgaaaatgtcgatgaaattaagaagatccttttaaatcatgatctttttaagatggaaaaacaaaaacaagtcgctaaattactgaacgttgataccgatgataaacaattgaaaaaagaaaataccgctttggcaagtaattttagcaaggcgattttgggatataaatttaatttagcgttagtgacaaaaattcctgatcaagataaaaaagaatggacgattagcttaggggatgaagattttgatgatcgcttggacaatgtgcctgtagccttgactgaaagccaacttgaagtggttgaagttttacattcaatttttaacagtatctcattgaatgaaattgttgaaaacggagaaacattatcttctgcaatggttaggaagtataacgatcacaagcacgacttaaaattgttgaagaacgtgatgaccactttagaagatcggaaaaaagctaaaaaaattcaaggaatttataatgtctttgttggtaaagacacggaccttatttcggataaagataagaataaatataaggataaagatgagttttataaagaaattcaaaaaaatcttgataattctagtgatgcagaagaaattattaaacgaattaaacaagatcaatttcttccaaaacagcgaacatctaaaaatggagttatcccacaccaattgcatcaacgagaattagatttgatcattgaaaaccaagcaaaatattatccttttttaaaggaagcaaatccaaacaagaagcgattaaagcaggcaaaatataaattagacgaattaatcgcgtttaaaattccttattatatagggcctacatcgggtgctgaaaattctgatttttcgtggttaaaacgaaaaaaagatgggcagattactccttggaactttgacgaaaaggttgaccgcatcgagtccgcaaaccgatttatccgacgcatgactaccaaagatacatacttattagctgaggatgttttaccacttgaaagcctaatttacgaaaaatatagtgttttaaacgaattaaacaacgttcggatcaacagacagaagttgagcgttaatgataaacaagatatttataatgaactgtttaagaatagtaaaacggtcaccctaaaacagttacaaaaatattttgaagtaaccaagaagttaaaaacggtggtagtagagggattggccgatcctaaaaaatttctttcaaatttaggaacgtatcatgattttaaactaatatttggtgacatcgttgatgatccagaatatcaaacggatcttgaaaacattatcgaatggtcgacgatctttgaagaccgtggaatttttaatagcaaattaaacgaaattacttggcttactgatgagcaaagaaaaaaagttttatctaaacgttatcaagggtggggtcgattctctaaaaagctgttagttgggttaaagaattcgcaaggaaactcaattttagacgagctttggaatacgaaccttaatttcatgcagctacagagtcaagacgattttgccgaattaattcatgcagaaaatgcaaaacaatttaaagcaaacgatcccgataatccttggaatggaattgatgccattttaaacgacgcctatacttcaccacagaataaaaaagcaatccgacaagttgtgaaggttgttcaggatatcgaaaaggcaatgggaaacaaacctcagaaaattgcaattgaatttacacgctcggctgataaaaatcctcgaagaacggatagtcgaattaagcggctgtctgatatatataaagaggcggccgagaaagttgtcggtgaatctttaaagttagagttaaatgaatatttaacttctaagaaaaaaatgacggataaaatgtatctttattttactcagttgggaacggatatttatacgggaaagaagattgacattgatcagttaaataattacgatatcgaccatgttttgccacagtcatttttaaaagatgactccttggacaatcgagtcttaacaaacagaagtgataatagtgagaagagcgatacagttccgctgcataaatttggcgcaaagatgggtaatttttggcggcaacttgctgatgaaggattgattaccaaacgaaagtacaagaacttgactaccgacccagccacaattgataaatacacaatacaagggtttatcaggcgtcaattggtggaaacaagccaagttattaagctgaccgcgaatattctgggaggattatatccagaagaaacagaaattttagaaatacctgccaaactaaaccaccagttccgggatatgtttgatttagtgaaggtgcgggaagtaaatgattaccatcatgcttttgatgcttatataacagtatttgtcggaaattttctttacagaagatatcctaaattaaggtcgtactttgtatatggtgactttaaaaaattaaataaaaccgatgacgatattcgaaagtttaattttttgaatttatttaataaagataaagttgaggataatgaaacggacgaaatcctttggtctaaagcggaatcgataagggacattaagaacatttataattacaagtttatgttagtttcgagggaagtttacactaggcacggggcaatgttcaatcagacaatctatcccgcctcgaaaaatgattcaaaaaaattaattccaattaaaaagggcaaggatactgcaatttatggcggatacagtggaaatactgacgcctatatggcaatcgttgctgttgaagacaaaaagggcgagaaattcaaagtggtcggcgttccgacacgggcggttagccgattagaacaattagcagccgatgatcacgatcagtatcttacggcactccatgatgtgttgaagccaaatttcacgaagattaaaacaaatcgaaaaactaaagcgaaggaagaagtgacaacaccattccgaattttagttggaaaagttggttatcgtcaattaattcaagatggtcaggtaaaaatgatgctgggaagctcagcttataaatataatgctaaacaattggtgctttcggaaaaatctttaaaagttattaaaaacaataaaaagtataatcctgatgatgaaaatcaagatttaattgatgtttacgatgagatattgggagtggttaatcgagcgtttaatttatatgacacgaacggctttagaaagaaattgaatgataatagagtgaagtttgttgaattaccaatcaataatatatttgatggtacaaaattagttcaaatgggtaaaagagcggttttgacgcaaattttaaatggcttacacgcaaatgcggcgcttggtgatctgaaggctttgggtatctcaacgccgtttggaaagatgcagagcaaaagtggtattccattatcgatggacgcttctttggtttatcaatcaccaactggactttttgaaagaaaactaaatttaagcgatctt

SEQ ID NO: 365 - DNA, 4113 bp, Steptococcus agalactiae GB00300
atgaataagccgtattcaataggccttgacatcggtactaattccgtcggatggagcattattacagatgattataaagtacctgctaagaagataagagttttagggaacactgataaagaatatattaagaagaatctcataggtgctctgctttttgatggtgggaatactgctgcagatagacgattgaagcgaacagctcgtcgtcgttatacacgtcgtagaaatcgtattctatatttacaagaaatttttgcagaggaaatgagtaaagttgatgatagtttctttcatcgattagaggattcttttctagttgaggaagataagagagggagcaagtatcctatctttgcaacattgcaggaagagaaatattatcatgaaaagttcccaacgatttatcacttgagaaaagaattggctgacaagaaagaaaaagcagaccttcgtcttgtttatctggctctagctcatatcattaaattcagagggcatttcctaattgaggatgatagatttgatgtcaggaatactgatattcaaaaacaatatcaagcttttttagaaatctttgatacaacttttgaaaataatgatttgttatctcaagatgtagacgtagaggcaattctaacagataaaattagcaagtctgcgaagaaagatcgtattttagcgcagtatcctaaccaaaaatctactggtatttttgcagaatttttgaaattgattgtcggaaatcaagctgacttcaagaaacatttcaatttggaggataaaacgccgcttcaattcgctaaggatagctacgatgaagatttagaaaatcttcttggacagattggtgatgaatttgcagacttattctcagcagcgaaaaagctatatgatagtgttcttttatctggcattcttacagtaacagatctcagtaccaaggcgccactttctgcctctatgattcagcgttacgatgaacatagagaggacttgaaacagttaaaacaattcgtaaaagcttcattgccggagaaatatcaagaaatagttgctgattcatcaaaagatggctacgctggttatattgaaggcaaaactaatcaagaagcattttataaatacttgtcaaaattgttgaccaagcaagaaggtagcgagtattttcttgaaaaaatcaagaatgaagattttttgagaaaacaaaggacctttgataatggctcaattccacaccaagtccatttgacagaattgagggctattattcgacgtcaatcagaatactatccattcttgaaagagaatctagataggattgaaaaaatccttacctttagaattccttattatgtcgggccactagcacgtgagaagagtgattttgcatggatgactcgcaaaacagatgacagtattcgaccttggaattttgaagatttggttgataaagaaaaatctgcggaagcttttatccatcgtatgaccaacaatgacctctatcttccagaagaaaaagttttaccaaagcatagtcttatttatgaaaaatttactgtttacaatgaattaacgaaggttagatttttggcagaaggctttaaagattttcaatttttaaataggaagcaaaaagaaactatctttaacagcttgtttaaggaaaaacgtaaagtaactgaaaaggatattattagttttttgaataaagttgatggatacgaaggaattgcaatcaaaggaattgagaaacagtttaacgctagcctttcaacctatcatgatcttaaaaaaatacttggcaaggatttccttgataatacagataacgagcttattttggaagatatcgtccaaactctaaccttatttgaagatagagaaatgattaagaagcgtcttgacatctataaagatttttttacagagtcacagcttaaaaagctctatcgccgtcactatactggctggggacgattgtctgctaagctaataaatggcatccgaaataaagagaatcaaaaaacaatcttggactatcttattgatgatggaagtgcaaaccgaaacttcatgcagttgataaaagatgctggtctatcatttaaaccaattattgacaaggcacgaactggtagtcattcggataatctgaaagaagttataggtgaacttgctggtagccctgctattaaaaaagggattctacaaagtttgaaaatagttgatgagctggttaaagtcatgggctatgaacctgaacaaatcgtggttgaaatggcacgtgagaaccaaacgacagcaaaaggattgagtcgttcacgacaacgcttgacaaccttaagagaatctcttgctaatttgaagagtaatattttggaagagaaaaagcctaagtatgtgaaagatcaagttgaaaatcatcatttgtctgatgaccgtcttttcctatattaccttcaaaatggtaaggatatgtatactgatgatgagcttgatattgataatttaagtcaatatgatattgaccacattattcctcaagctttcataaaagatgattctattgataatcgtgttttggtatcatctgctaaaaatcgtggaaagtcagatgatgttcctagccttgaaattgtaaaagattgtaaagttttctggaaaaaattacttgatgctaagttaatgagtcagcgtaagtatgataatttgactaaggcagagcgcggaggcctaacttccgatgataaggcaagatttatccaacgtcagttggttgagacacgacaaattaccaagcatgttgcccgtatcttggatgaacgctttaataatgagcttgatagtaaaggtagaaggatccgcaaagttaaaattgtaaccttgaagtcaaatttggtttcaaatttccgaaaagaatttgtattctataaaattcgtgaagttaacaattatcaccatgcacatgatgcctatcttaatgcagtagttgctaaagctattctaaccaaatatcctcagttagagccagaatttgtctacggtgactatccaaaatataacagttacaaaacgcgtaaatccgctacagaaaagctatttttctattcaaatattatgaacttctttaaaactaaggtaactttggcggatggaaccgttgttgtaaaagatgatattgaagttaataatgatacgggtgaaattgtttgggataagaagaaacattttgcgacagttagaaaagtcttgtcataccctcaggtcaatatcgtgaagaagacagagattcagacaggtggtttctctaaggaatcaatcttggcgcatggtaactcagataagttgattccaagaaaaacgaaggatatttatttagatcctaagaaatatggaggttttgatagtccgatagtagcttactctgttttagttgtagctgatatcaaaaagggtaaagcacaaaaactaaaaacagttacggaacttttaggaattaccatcatggagaggtccagatttgagaaaaatccatcagctttccttgaatcaaaaggctatttaaatattaggactgataaactaattattttgcccaagtatagtctgttcgaattagaaaatgggcgtcgtcgattacttgctagtgctggtgaattacaaaaaggtaatgagctagccttaccaacacaatttatgaagttcttataccttgcaagtcgttataatgagtcaaaaggtaaaccagaggagattgagaagaaacaagaatttgtaaatcaacatgtctcttatttcgacgatatttttcaaataatcaatgatttttcaaaacgagttattctagcagatgctaatttagagaaaatcaataggctttaccaggataataaggaaaatataccagtagatgaacttgctaataatattatcaatctatttacttttaccagtctaggagctccagcagcttttaaattttttgataaaatagttgatagaaaacgctatacttcaactaaagaagtacttaattctaccctaattcatcaatctattactggactttatgaaacacgtattgatttgggtaagttaggagaagattga

SEQ ID NO: 366 - DNA, 4113 bp, Steptococcus gallolyticus ATCC BAA-2069
atgactaagaaaaattattcaatcggacttgacataggtactaatagcgtaggttgggctgtgattactgatgattacaaagttccagctaaaaagatgaaagttttaggaaatactgataaaaagtatatcaagaaaaacttactaggtgcattgttatttgacagtggcgaaacagctgaagcgactcgtttgaaacgtactgctcgtcgtcgttacacacgccgtaaaaatcgtttgcgttacctacaagaaatttttgcggaagaaatgactaaagttgacgaaagcttcttttatcgtcttgacgaatcatttttgacaacagatgaaaaagattttgaacgtcatccaatttttggcaataaagcagaagaagatgcctatcatcagaaattccctacaatttaccatttaagaaactatcttgcagattcatctgaaaaagcagatttacgtttggtttatctagctttggcacacatgattaaatatcgtggacatttcttaattgagggaaaattgaatgccgaaaatacagatgttcaaaaactatttactgatttcgtaggagtgtatgatagaacatttgatgatagtcacttatcagaaattacggttgatgttgcaagtactttgacagaaaaaattagcaaatcacgtcgtttagagaatcttattaaatactacccaacagaaaagaaaaatactttatttggaaatcttattgctttggctttaggattacagcctaattttaaaatgaatttcaaattatctgaagatgctaaattgcaattttctaaagatacctacgaagaagatttagaagagttacttgggaaaattggagacgattatgcagatttatttacttcagctaaaaatctttatgatgcaatcttactttcaggtatcttaactgttgatgataattcaactaaagctcctttatcagcttcgatgattaaacgttatgttgaacaccatgaagatttagaaaagctaaaagaattcattaaggcaaataaatctgagttgtatcacgatatttttaaagataaaaacaaaaatggttatgcgggctatattgaaaatggtgtcaagcaggatgaattctataaatatttaaaaaatactctctctaaaattgatggaagtgattatttcctagataaaattgaacgtgaagatttcttaagaaaacaaagaacatttgataatggttcgattccgcaccaaattcatctccaagaaatgcatgcaattttgcgccgtcaaggtgattattacccatttctaaaagagaagcaagatagaattgaaaaaatcttgacttttagaatcccttactatgtcggaccattagtgcgaaaagatagccgatttgcatgggcagaatatcgttcggatgagaagattacaccgtggaatttcgataaggtaatcgataaagaaaaatcagctgaaaaattcattacacgcatgactttaaatgatttgtatttaccagaagagaaagttctaccaaaacacagtcatgtatatgaaacatatgcggtttataatgaattaaccaaaattaagtatgtcaatgagcaaggaaaagaatctttctttgattcaaatatgaaacaagaaatctttgaccatgtctttaaagaaaatcgtaaagttaccaaggaaaaacttttaaattaccttaataaagaatttcctgaatatcgtattaaagatttaattggacttgataaagaaaataaatctttcaatgctagtcttggaacttaccatgatttgaaaaagattttggataaagctttcttggatgataaagtaaatgaagaagttattgaagatattattaaaacgttaactttgtttgaagataaagatatgatccatgaacgtcttcaaaaatatagtgacatttttacagctaatcaattgaaaaaacttgaacgacgtcattatactggttggggacgtttgtcatataaattaattaacggtatccgtaataaagaaaataataagaccattcttgattatctgattgatgatggttctgctaatcgtaactttatgcagttaattaacgatgatacattaccatttaaacaaatcatccaaaaatcgcaagttgttggtgatgtcgatgatattgaagctgttgttcatgatttacctggaagtcctgctattaaaaaaggtattctacaaagtgtcaaaatcgttgatgagctagttaaagtgatgggagataatcctgataatattgttattgaaatggcgcgtgaaaatcaaacaactaatagaggaagaagccagtcccaacaacgtttgaaaaaacttcagagctcattaaaagagttaggaagtaatattcttaatgaggaaaaaccgtcatatattgaagataaggttgaaaatagtcatcttcaaaatgatcaactcttcctttactacattcaaaatggtaaagatatgtacactggtgatgagttagatattgaccatctaagcgattatgatattgaccacattattcctcaagcctttattaaggatgactctattgataatcgagtactaacaagttctgctaaaaatcgaggtaaatcagatgatgtaccaagtcttgatattgttcgtgctagaaaggcagaatgggttcgattgtataaatcaggactaatctctaaacgtaaatttgataatttaacgaaagccgaacgtggtggattgactgaagcggataaggctggatttattaaacgtcaattggttgaaacacgtcaaatcacaaaacatgtggcacaaattttagatgctcgttttaatacagaacatgatgaaaatgacaaggtgattcgtgatgtgaaagtcattactttaaaatcaaatctggtttcacaattccgaaaagattttgaattttacaaagttcgtgagatcaatgattatcatcatgctcatgatgcttatcttaatgcggttgttggaacagcattattgaaaaaatatcctaaattagcttctgaatttgtttatggtgagtacaagaaatatgatattcgtaaatttatcactaattcaagcgataaagcaacagcgaaatatttcttctattcaaatttgatgaatttctttaaaactaaggttaaatatgcggatggtactgtctttgaacgacctattatcgagacaaatgctgacggtgaaattgcttggaataagcaaattgactttgaaaaagttcgaaaagttttatcctacccacaagtcaatattgttaaaaaggttgaaactcagacgggaggattctcaaaagaatcaattttacctaaaggtgactctgataaattaattccacgaaagacaaaaaaagtttattgggatactaaaaaatatggtggttttgatagtccaacagtagcttattctgtttttgttgtagctgacgtcgaaaaaggtaaagctaagaaattgaaaactgtaaaagagctagttggtatttctatcatggaacgttctttctttgaagaaaatccagttgaattcttagaaaataaaggatatcacaatattcgagaagataaattaataaaacttccaaaatacagtctttttgaatttgaaggtggaagaagacgcttgttagctagtgcttcagaacttcaaaaaggaaatgaaatggtgcttccaggatatttagtagaattgctttatcatgctcatcgagctgataattttaatagcactgaatatttaaattatgttagtgagcataagaaagaatttgaaaaagttttatcttgtgtggaagactttgctaacttatatgttgatgttgaaaaaaatttaagtaaaattagagcagttgcagatagtatggataacttctcaattgaggaaatttcaaattcatttattaatttattaacactgactgcattaggtgcgccggctgatttcaatttccttggtgaaaaaattccacgtaaacgctatacctcaacaaaggaatgcctgactgccacccttatccaccaatctatcactggtctttatgaaacacgtattgatttgagtaaattaggagaagagtaa

SEQ ID NO: 367 - DNA, 3387 bp, Steptococcus mutans NLML5
atggctaatagtaaaattttaggtttggatattggcattgcttccgtaggtgttggaattattgataaggaaacgggtaagattattcatgttaattcacgaatttttccggcagctacagctgatagtaatgttgaaagacgaggatttcgtcaaggacgtagattagttcgccggaaaaaacatcgtaaagttaggctggcagatttgtttcttgactcaaatcttttaacggacttttctaaagtatcccttaacttgaatccttatcaactacgtgttaaaggattaaatgaagaattaagtaatgaagaattgtttattgctttaaaaagcatagtcagccgtagaggaataagttatcttgatgatgctagcgaagatagcggagctaattcttcagaatatggaaaagctgtggaagaaaatcgaaagctgcttgaagataggactcctggacaaatccaattggaacgctttgagaaatatggcaaagttcgtggggattttacagttgttgaaaatggggagaatcatcgtttaattaatgtattttctacttcagcctacaaaaaagaagcagagcgaattcttagaaggcaacaagaattcaatattaggattgcagatgaattcattgaagcttatttaactattttgactggcaaaagaaaatattatcatgggcctggaaatgaaaaatctagaacagattacggaagatttcggacagatggcacaactcttgataatatttttggtattttgattgggaaatgcactttttatcctgatgaatatcgggctgcaaaagcttcctatacagctcaggaattcaatttactcaacgatttaaacaatttaacagtaccgacagagactaagaagttaagtgaagaacaaaaacgacagattattgaacatgcaaaaactgtaaaaactttaggggctccaaccttattgaaatacattgctaagttggttggctgctctgctgacgatataaaaggctatcgaattgataagtccgataagcctgaaatccatacttttgaagcctatcgtaagatgcggaccatggagttaatcaaggttgctgacttatcacgtgaaagcttagatgcacttgctcatattcttacgcttaatacagaacgagagggtattgaagaagctatcagagacagatttactaataaagagtttaatcaggaacaaattaatgaactggttctgtttaggaagaataacagttctttatttggaaaaggatggcacaatttttcacttaagttgatgaaggaactgattccagagctttatgagacttctgaggaacaaatgacaattctgacaaggcttggaaaacagagagtgaagaaatcttctaatagaaccaactatattgatgaaaaggaattgactgaagaaatctataatccagtagttgctaaatcagttcgccaggctattaagattatcaatcttgccacaaaaaaatatggtgtttttgataatattgttatagaaatggcgcgtgaaagcaatgaagatgatgagaaaaaagcgattcagaatgctcaaaaagcaaatgaagatgaaaaggaagcagccttgttaaaagcggctcatcagtttaatggtaaagaagagctcccagacagcattttccatggacacaaagaactgttgacaaaaattcgtctctggcatcagcaaggcgaaaagtgtctttatactggaaagactatattcattaatgacttgattcacaatccttataaatatgaaattgatcacatcttacctctatcactatcatttgacgatagtctggcaaataaagttttggtcctctccactgccaaccaagagaaaggtcaacgaactccgttccagtctctagatagtatggatggtgcttggacttatagagagttcaaagcctatgtaaaaggattaaaaacactgagcaataaaaagaaagattatcttctaaatgaggaagatattaataagaatgaggtcaaacaaaaattcattgaacgaaatttagttgatactcgctattcatcacgtgttgttctgaatactttgcaagatttctacaaaaaaagagaatttgatacaaagatctctgttgttcgtggacagtttacttcccaaatcaggagaaaatggcggattgagaaaacacgggaaacttatcatcatcatgctgtcgatgctttgatcatcgcagcatccagtcagctcaatctttggaagaagcaaaataaccctctaatttcctacaaggaagatcagtttgtagatccagaaactggtgagattctttctctgtcagatgatgaatataaggaattagtatttaaggctccctatgatcactttgtggatacattgaaaagtaagaaatttgaagatagcattctcttttcttatcaggttgattctaagtataatcgcaagatatcagatgctactatttatggcacgagaaaagctcgacttgggaaagatagccaagaagaaacttatgtacttggaaaaattaaggatatctattctcaaaaaggctatgaagactttatcaagaagtataagaaagataaaactcagtttttgatgtaccataaggacccacaaacgtttgaaaaggttattgaagaaattctcaaaacctattcggacaaagagttgaacgaaaaggggaaagaagttccttgcaatccttttgaaaaatatagacaggaaaatggacctgttcgtaaatacagtaaaaaagggaatggcccggaaattaagagcattaagtattatgacaataaactcggcaatcatattgatattactccaaataatagtcatcatcaggttgttttgcagtctttgaaaccttggcgaacagatgtttattttaatcctaagtcaggtaagtatgaactgatgggactaaagtattcagatttacgatttgaaaaagtaagtggagattatggcatttcggttaaaaaatataatgaaatcaaatcaaaagaaggagtcgacgagaattcagaatttaaatttaccctttataagaacgatttgattttgattaaagatactgaaagtggagaacaggagttgtttagattcttgtccagaacgatgccaaatcaaaaacattatgttgagttaaaaccttatgataaatctaagtttgaagggcatcaaaaattaatggacatatttggagaagttgctaaaggcggtcaatgcctcaaagggctaaacaagtccaacatctccatctacaaggtcaaaacagatgttcttggtaataaatatttcattaaaaaagagggtgatcagccacagctcaattttaagaaaaaaatctaa

SEQ ID NO: 368 - DNA, 4123 bp, Steptococcus oralis SK304
atggaaaacaaaaattactctatcggactcgatatcggaactaacagcgtcggatgggccgtcattactgacgattataaagttccatcgaaaaagatgaaagttctgggtaataccgataaacgatttatcaagaaaaatctcatcggggctctattgtttgatgagggaactactgctgaggctagacgccttaaacgaactgcacgtcgtcgctatacccgccggaaaaatcgtcttcgctatcttcaagaaatctttgctgaggaaatgagcaaggtagatagtagtttctttcatcgattggatgactcctttttaattcctgaggataaaaaagggagtaaataccctatttttgctaccttgatagaagaaaaagaatatcataagcaattcccaactatttatcatttgagaaagcaattagcagattcaaaagaaaaaactgacttgcgattgatttatctagcattagctcatatgattaaatatcgcgggcattttttatacgaagatacatttgatattaaaaacaatgatatccaaaaaatctttaatgaatttataagcatttacaacaacacctttgaaggaaattcgcttagtggacaaaacgtacaagtagaagcaatttttactgataaaattagcaaatctgcaaagagagaacgcgttctaaaactctttcctgatgaaaaatccactggtctcttttcagaatttctcaagttaattgtaggaaatcaggctgattttaaaaaacattttgacttagaagaaaaagctccactacaattctctagagatacctatgatgaggatttggaaaacttactcggacaaattggagatgactttgcagaccttttcgtggccgctaaaaaactctatgatgcgattcttctatcaggcattttgactgtcacagatccttcaaccaaggctccactgtcagcatctatgattgagcgctatgaaaatcaccaaaaagacttagccactttaaaacaattcatcaaaaccaatcttccagaaaaatatgatgaagtcttttctgaccaatctaaagatgggtatgctggatatatcgatggcaagaccacacaagaatccttttacaaatatatcaaaaatcttctctctaaattcgaaggagcagattatttccttgagaaaattgaacgtgaagattttttgagaaaacaacgtacctttgataatggttctattcctcatcaaattcatcttcaagaaatgaatgccattctccgtcggcaaggagaacattatccattcctgaaggaaaacaaagaaaagattgaaaaaatcttaaccttccgtatcccttactacgtcggcccattagctcgtggcaatcgtgattttgcttggctgactcgaaattctgaccaagcaatccgaccttggaatttcgaagaaattgttgataaagcaagctctgcggaatccttcatcaataaaatgactaactatgacttgtatctcccagaggaaaaagttttgcctaagcatagtctgttgtatgaaacatttgctgtctacaatgaattaacaaaagtaaaatttattgcagaaggattgagagactatcaattccttgatagcaggcaaaagaaagatattttttatactctttttaaggccgaggataaaagaaaagtaaccgaaaaagacatcatccagtatctacatactgttgatggctacgatggaatcgaactaaaaggaattgaaaaacaatttaacgctagtctttctacttatcatgatttactcaagattatcaaggataaagagtttatggatgaccctaataatgaagagattcttgaaaatatcgtccatacgctaactatctttgaagatcgtgagatgattaagcaacgccttgctcaatatgactctctctttgatgagaaagttattaaagcactaactcgtcgacattatactggttggggaaaactctcttctaagctaattaacggtatccgcgataaacaaactggcaaaacgattcttgattatctaatggatgatggctacaacaatcgtaactttatgcagttaatcaatgatgacgagctttctttcaaagaaattatcaaaaaagcacaagtggttggtaagacagatgatgtgaaacaagttgttcaagaacttccaggaagccctgccattaaaaagggaattttacaaagtatcaagcttgttgatgaacttgtcaaggttatgggacacgaacctgagtccattgtgattgagatggcacgagaaaatcagacaactgccagagggaaaaagaattcccaacaaagatataagcgaattgaagattcgttgaaaatcttagcatctggtcttaacgccaaaattctaaaagaacatccaacagataatattcaacttcaaaatgatcgtctcttcctctactatctccaaaatgggagggatatgtatactgggaaacctcttgacatcaaccaactgagcagctatgacattgaccacatcgtcccacaagcctttatcaaggatgattctcttgataaccgtgtcttgacgagtttaaaggataatcgtggcaaatctgataatgtcccaagtcttgaagtagttgaaaagatgaaaactttttggcaacaattgttggattccaaattgatttcttaccgtaaatttaataatttaaccaaagctgaacgcggcggactagatgagcgagataaagttggttttattaaacgccaactagttgaaacacgtcaaatcacaaaacacgttgctcagatcttagatgctcgctataatacagaagtgaatgagaaggataagaagaaccgtaccgtcaaaatcatcactttgaaatccaacctggtttccaacttccgtaaagaatttaggttatacaagatacgggaaatcaacgactaccaccatgcacatgatgcctatttaaatgcagtggttgctaaggctatccttaagaaatatcctaagctagagcctgaattcgtctatggtgactatcaaaagtacgatcttaagagatacatctcaagatccaaagaccctaaagaaatcgaaaaagcaactgaaaagtatttcttctactcaaacttgttgaacttctttaaagaagaggtgcattacgcagacggaactatcgtaaaaagagagaatatcgaatactccaaagataccggagaaatcgcttggaataaggaaaaagatttcgctacaatcaaaaaagttctttcacttccgcaggtgaatattgtgaagaagcgagaggtgcaaacaggtggcttctctaaagagtccattcttcctaagggaaattctgataagctaatccctcgaaaaacaaaggatattctttgggacactactaaatatgggggatttgatagtccggttatcgcctactcaatcttgctcattgccgatatcgaaaaaggaaaagcaaaaagactgaagactgtcaaaactctagttggtatcacgattatggaaaaagccacttttgagaagagtcctatagctttccttgaaaataaaggctatcataatgtccgtaaagaaaatatcctctgcctacctaagtatagtttatttgaactgaaaaatggtcgcagacggatgttagcaagtgcgaaagaacttcaaaaaggcaatgaaatcgtgcttccagtacatttaacaaccttgctctaccatgctaaaaacattcatagactagacgagccagaacatttggaatatattcagaaacaccgaaatgaatttaagggtttattaaatcttgtatctgagttctcccaaaaatatgtcctcgcagatgcaaatctagagaaaatcaagaacttatatgcagacaatgagcaggcagatatagaaatcctagcaaattcgtttatcaatttgttgacctttactgctttgggtgctcctgctgcctttaaattttttggcaaagatgttgatcgaaaacgatacacaactgtatccgaaatcctcaacgccaccctcatccaccaatccatcactggtctctacgagactcggattgacttgagcaaactaggagaagactaat

SEQ ID NO: 369 - DNA, 3378 bp, Streptococcus anginosus 1_2_62CV
atgaacggtttggttttaggattggatatcggtattgcttctgtcggagtgggaattttaaataaagaaacaggcgagattattcatgctaattcgagaatttttccagctgcaactgcagacagcaatgtagaacgtcggggatttagacaaggaagaagacttggtcgaaggaagaaacatcgcagcgctcgcttaaacaacctttttgaagaattcggttttataacagatttttctgctatccctttaaatttaaatccttatgctctgcgtgtgaagggattaagcgaagaattaacaaatgaagagttgtttattgcgcttaaaaacattattaaacggcgtggtatcagctatctagacgatgctagtgaagatggagaaacagcttccaatgagtatggaaaagcagttgaagaaaacagaaaattacttgcagacaaaacgcctggacaaatccagttggaacgttttgaaaaatacggacaagttcgtggggattttacagttgttgaaaatggggagaatcatcgtttaattaatgtattttctacttcagcctacaaaaaagaagcagagcgaattcttagaaggcaacaagaattcaatgtgaggatttcagatgaattcattgaagcttatttaactattttgactggcaaaagaaaatattatcatgggcctggaaatgaaaaatctagaacagattatggaagatttcggacagatggcacaactcttgataatattttcggtattttaattggaaaatgtactttttatcctgatgaatatcgagcagcaaaggcgtcttataccgcgcaggaatttaatttgctcaacgacctcaataatttaacagttccaactgaaacgaaaaaattgagtccagaacaaaagcggcagattgttgagtatgctagaactgcaaaaactttaggaactccaactttactgaaatatattgctaagttagtagacggttctattgatgacataaaaggatatcggattgataaatctgataaaccggagatgcatacttttgacgcctatcgtaaaatgagaacactagatctggtgaatatagatgcattatcgagagaaaccttagacgacttagcacacattctaaccttgaatacagaaagtgaaggtattttagaagctcttaacagtaaaatgcctagtacatttaccaaagagcagattgatgagttaattcagtttaggaagaaaaacagtgcggtatttggaaaaggttggcataatttttctcttaagttaatgaatgaattgatttcggagctttatgagacttcagaggagcaaatgactattttgactcgtctaggtaaacagagaagtagagaaatttcaaaacgaactaaatacatagatgaaaaagaattaacagaagaaatctataaccctgtagtagcaaagtctgtcagacaggcaataaagataatcaatgaagcaactaaaagatatggtatttttgataatatcgttatcgaaatggctcgtgaaaataacgaagaagatgcaaagaaagattatatcaagcgtcaaaaagcaaaccaagatgagaaaaatgcttctatggaaaaagcggctttccaatacaatggaaaaaaagagttaccagatagtatttttcatggccataaggaattagctactaagattcgtttatggcaccagcagggagaacgctgcctttatacgggaaagaatatctctattcgtgatttaattcataatccacatcagtatgaaattgatcatattctgccgctttcactttcttttgatgatggcttggccaataaggttctggtgctagcaacagctaatcaggaaaagggacagagaacaccattccaggctatagatagtatggatgatgcgtggtcttacagggagttcaaacaatatgtccggaattctaaaagcttaagtaataagaaaaaagactatctgctgaccgaagaagatatcagcaagattgaagtaaaacaaaaattcattgagcgcaatctcgtggacacacgttactcatcacgggtagtcctaaatactttgcaggaattttacaaaacaaatgatttcgatacaaaaatttcggttgttcgtggtcaatttacatcacagctgagaagaaagtggaaaattgaaaaaagtcgtgatacctatcaccaccacgcagtagatgctctcatcattgcggcctccagtcagttaagactctggaaaaagcagaataatcctttgatttcttataaagaagggcagtttgtagatcctgaaacgggagagattctttcactgacagatgacgaatataaagaacttgttttcagaccaccatatgattattttgtagatacattgaagagcaaatcgtttgaagacagtatcttgttttcttatcaagtggattctaaatataaccgaaaaatatcagatgctacaatctatggaactagaaaagctcagttggggaaagataagcaggaggaaacttatgtacttggaaaaattaaggatatctattctcaaaagggttatgaagattttatcaagagatataataaagatgaaactcagttcttgatatatcacaaagatccacagacctttgaaaaagttattgaagaaattcttaaaacctatcctgacaaagagttaaacgaaaagggtaaagaaattccctgcaatccttttgaaaagtacagacaagaaaatggtcctattcgaaaatacagcaaaaagggcaaaggcccagagattaaaagccttaagtattatgataataaacttggtaatcatattgatattactcctgtaaacagtcagaaccaggttgttttgcagtccttgaagccttggcggacagatgtttattttaatccccggacttccaaatatgaattgatgggattgaaatactcagatttaagatttgaaaaagggagtggaagctacggtatttcacctgaaaaatataataaagtcaaagcaaaagaaggagtgaacgaggattcagaatttaaatttactttatataagaacgatttgattttgataaaagacaccgaaactggagagcagcaattatttaggtatggttcgcgaaacgatacctcaaaacattatgttgagttaaaaccttatgaaaaagctaaatttgaaggaaatcaacagctgatgaatttgttaggaaccgttgcaaaaggtggtcaatgcctcaaagggataaacaagcctaatctctccatctataaagtcaaaacagatgttcttggtaataaatatttcattaaaaaagagggtgatcagccacagctcaattttaagaaaaaattttaa

SEQ ID NO: 370 - DNA, 4191 bp, Streptococcus anginosus DSM 20563
atgactaaaccatactcaattggcctcgatattggtaccaacagtgtaggttgggctgtgattactgatgactataaagttccagctaagaagatgaaagttttagggaatacaaatcgagattatatcaagaaaaatcttttaggtgcccttttgtttgatgggggagaaacagctgagggaagacgcttgaaacggactgctaggcgccgttatactcgccgaaaaaatcgtctacgctatttgcaagaaatttttgctgaggaaatgatgcaagtcgatgagagtttttttcagcgcttggatgattcatttcttgttgaagaagataagcaaggaagcaaatatcctatttttggaactttaaaagaggaaaaagagtatcataaaaaatttaaaacgatttatcatttaagggaagaattagcaaattcaaaagagaaagctgatttgcgtttggtgtatttggctttggctcatatgattaaattccgtggtcactttctctatgagggcgacctaaaagctgaaaatacagatgttcaagcattatttaaggattttgtagaagaatatgataagactattgaagaaagccatttatcagaaataacagttgatgcattaagtatcctaacagaaaaggttagtaagtctagccgtttagaaaaccttattgctcattatccaactgagaagaaaaatactttatttgggaatcttattgctttatctttggggctacaggcaaactttaaaacgaatttccaattatctgaagatgctaagttgcaattttctaaagatacgtacgaagaagatttagaagggttacttggggaagttggagatgaatatgcggacctgtttgtatctgctaaaaatctttacgatgccatcttgctgtcagggattttgacagtagatgataactcaacaaaagcacctttgtctgcttcaatggttaaacgctataaagaacacaaagaagaattagctgcttttaaacgttttataaaggaaaaacttcctaaaaaatatgaggaaatttttaaggatgatacaaaaaacggttatgcaggctatgttggtgctgataaaaagttacgaaaaagaagtgggaaattagcaactgaagaagaattttataaatacgtgaaggggattttaaataaagttgaaggtgcagattattttcttgacaaaattgatcgtgaagattttctgagaaaacaaagaacatttgataatggttctattccgcatcaaatccatctgcaagaaatgcatgctatcttgcgacgccaaggtgaacactatccattcttgaaagaaaatcaagataagattgaaaaaatcttaacgtttagaattccttactatgttggtcctttggcgcgaaaaggcagccgttttgcctgggcagaatataaggcggatgaaaaaattacgccatggaattttgatgatattcttgataaagaaaaatcagcagaaaaattcatcacacgcatgactttaaatgatttgtatttacctgaagaaaaagtcttacccaaacacagtcctctatacgaaacctttaccgtttacaacgagttgaccaaagttaagtatgttaatgaacagggtgaagctaaattctttgatacaaatatgaaacaagagatttttgatcatgtttttaaagaaaatcggaaagttacgaaagataaacttttaaattatttgaataaagagtttgaagaatttagaattgttaacttaactggactggataaggaaaataaagcctttaatgcaagtcttggaacttatcacgatttgcgtaagattttagataaatcattcttagatgataaagtaaatgaaaagataattgaggatatcattcaaacactaactctgtttgaagacagagaaatgattcgccagcgtcttcaaaagtatagtgatatttttacaacacagcaattgaaagaattggaacgccgtcattacactggttggggacgcttgtcatacaagttgatcaatggcatccgaaataaagagaataagaaaacaatattagactatctaatcgatgatggttatgctaatcgtaattttatgcagttgattaatgatgatgctctttcttttaaagaagaaattgctagggcacaaatcattggtgatgttgatgatattgcaaatgtagtgcatgacttacctggaagtcctgctatcaagaaagggattttacaaagtgtcaaaatcgttgatgaattagtcaaagtaatggggcataaccctactaatattattatagagatggcgcgtgaaaatcaaacgacagataaggggcgtagaaattctcagcaacgtcttaaattattacaagattcattgaagaatttggacaatcctgtaaatattaagaatgtggaaaatcagcaacttcaaaatgatcgattattcttgtactatatccaaaatggcaaggatatgtatacaggagaaactttagatattaacaatctaagccaatatgatatagatcacattattccgcaagcctttattaaggataattcacttgataaccgtgtgctgactcgttctgacaaaaacagaggtaaatctgatgatgtaccaagtatagaagttgttcatgaaatgaagtcattttggagcaaacttctttcagtaaaactgattacacaacgcaaatttgataatttaaccaaggcagaacgtggcggtctgaccgaaaatgataaagcaggttttattaaacgtcagttagttgagacaagacaaattactaagcatgttgcgcaggttttagatgctcgttttaatgcaaagcatgatgagaataaaaaagtgattcgagatgttaaaatcattactttgaaatctaatctagtttcacaatttcgaaaggactttaagttttacaaagtacgtgaaattaatgattatcaccatgcacatgacgcttatctcaatgcagttattggaacagctttgttgaaaaaatatcccaaacttgcatcagaatttgtatatggtgaattcaaaaaatatgatgtccgtaaatttattgcgaaatctgataaggaaattggaaaagctacagcaaaatatttcttttattcaaatttgatgaacttctttaaaaaagaggttaaatttgcagacggtacagtagttgagaggcctgatattgaaacaagcgaggatggcgaaatagcttggaataaacaaaccgactttaaaattgttcgcaaggttctctcctatccgcaggttaatattgtgaagaagactgaggtacagactcatggtctagatagagggaagccaaggggactttttaatgctaatccttctcctaaacctaaaccagatagtagtgaaaatttagtggggataaagagaaatcttgaccctaagaaatatggtggttatgcaggtatttcaaattcttatgctgtattggttaaagcgattattgaaaaaggagtcaagaaaaaagaaacgatggtactagaatttcagggaatttccattttagaccgaattacttttgaaaaagataaaagagctttcttgttaggaaaaggatacaaagatattaaaaaaatcattgagctacctaaatacagcttgtttgaattgaaagatggatcccgtcgcatgttagctagcattctttcaacaaataataaacgtggagaaattcataaaggaaatgaattgtttgttccacaaaagtttacaactctgctatatcatgccaaacgaattaacaatccaatcaacaaagatcatatagaatatgttaagaagcatagagatgattttaaagagttgctcaactatgtattagaatttaatgaaaaatatgtgggggctactaaaaatggagagcgtttaaaagaagcggtggcggattttgacagcaaaagcaatgaagaaatttgtactagctttttaggagccgttaatagtaagaatgcaggcttatttgagttaacctcattaggaagtgcctcagattttgaatttcttggtgtaaaaattcctagatatagagattacactccctcatcgctattaaaggattctatcctcatccaccaatccatcacgggtctttatgaaacacggattgacttgagtaagttaggagaagattga

SEQ ID NO: 371 - DNA, 3468 bp, Streptococcus dysagalactiae subsp equisimilis
atggataagaaatactcaataggcttagatatcggcacaaatagcgtcggatgggcggtgatcactgatgattataaggttccgtctaaaaagttcaaggttctgggaaatacagaccgccacagtatcaaaaaaaatcttataggggctcttttatttgacagtggagagacagcggaagcgactcgtctcaaacggtcagctcgtagaagatatacgcgccgaaagaatcgtattcgttatttgcaggaaatctttagcagtgagatgtccaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggcagattctactgataaagcggatttgcgcttaatctatttggccttagcgcatatgattaagtttcgtggtcattttttgattgagggagatttaaatcctgataatagtgatatggacaaactatttatccagttggtacaaacctacaatcaattatttgaagaaaaccctattaacgcaagtagagtagatgctaaagcgattctttctgcacgattgagtaaatcaagacgattagaaaatctcattgctcagctccccggtgagaagagaaatggcttgtttgggaatctcattgctttgtcattgggattgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatagtgaaataactaaggctcccctatcagcttcaatgattaaacgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggcgaaactaaatcgtgaagatttgctgcgcaagcaacggacctttgacaacggctctattccccatcaaattcacttgggtgagctgcatgctattctgagaagacaagaagacttttatccatttttaaaagacaatcgtgagaagattgaaaaaatcttgacctttcgaattccatattatgttggcccattggcgcgtggaaatagtcgctttgcatggatgactcggaagtctgaagaaacgattactccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgagggaatgcgaaaaccagaatttctttcaggaaagcagaaagaagccattgttgatttactcttcaaaacaaatcgaaaagtaaccgttaagcaattaaaagaagattatttcaaaaaaatagaatgttttgatagtgttgaaatttcaggcgttgaagatcggtttaatgcgtcattaggtacctaccatgatttgctaaaaattatcaaagataaagattttttggataatgaagaaaatgaagatattttagaggatattgttttaacattgaccttatttgaagataaggaaatgattgaggaacgacttaaaacatatgctcacctctttgatgataaggtgatgaaacaacttaaacgtcgccattatactggctgggggcgtttgtctcgaaaattgattaatggtattagggataagcaatctggtaaaacaatattagattttttgaaatcagatggttttgccaatcgcaattttatacagctgattcatgatgatagtttaacattcaaggaagctattcaaaaagcacaggtgtctggacaaggccatagtttacatgaacagattgctaacttagctggcagtcctgctattaaaaaaggtattttacagtctgtaaaagttgttgatgaactggtcaaagtaatggggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctacaaaatagaagagacatgtatgtggaccaagaattagatattaatcgtttaagtgattatgatgtcgatcacattgttccacaaagtttcattaaagacgattcaatagacaataaggtcttaacgcgttctgataaaaatcgtggtaaatctgatgacgttccaagtgaagaagtagtcaaaaagatgaaaaactattggagacaacttctaaacgctaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctgaatgccgtcgttggaactgctttgattaagaaatatccaaaactagaatcggagtttgtctatggtgattataaagtttatgatgttcgtaaaatgattgctaagtctgagcaggaaataggcaaagcaaccgcaaaacgtttcttttattctaatatcatgaactttttcaaaacagaaattacacttgcaaatggagagattcgcaaacgccctctaatcgaaactaatgaggaaaccggagaaattgtctgggataaagggcgagattttgccacagtgcgcaaagtattgtccatgccacaagtcaatattgtcaagaaaacagaagtacagacaggtgcactgactaatgaatcaatttatgctagaggaagttttgataaattaatcagtcgtaaacatcgttttgagtcctctaaatatggaggatttggcagcccgactgttacttatagtgtgttagtagttgcgaaataccaaagttacaagatggaaaagtaa

SEQ ID NO: 372 - DNA, 4047 bp, Streptococcus equi subsp zooepidemicus
atgaaaaaaccttatactattgctcttgatattggtactaatagtgtaggatgggttgttgtgacggatgattatagggttccaacaaagaaaatgaaggtactaggaaatacagagcgaaaaaccattaagaaaaatttgattggtgccttattatttgatagtggtgatactgcagagggaactcgcttaaaaagaacggcccgtcgcagatatacaagaagaaagaatagactacgttaccttaaagaaatttttactgaggaaatggcaaaagtagatgatggtttctttcaacgactggaggattcattctatgttttagaggataaggagggaaataagcatccgatttttgctaatctagcagatgaagttgcttatcataaaaagtatccaacaatttatcatttacgaaaagagttagtagataatcctcaaaaagcagatttacgcttaatttatttggcagtagcgcatattattaagtttaggggacattttctgattgagggaacattaagttcaaagaataataatcttcagaaatcatttgatcatcttgtggatacctataatctattgtttgaggagcaacgattgcttactgaaggcattaatgccaaagagctgttgtctgcagcattaagtaagtcaaagcgtttagaaaatctcatttctctgattcctggacaaaagaaaacgggtatttttggtaatattattgcactctcgctaggattaacaccaaattttaaagctaattttggtttaagtaaggatgtcaaattacagttggctaaggatacctatgctgatgatttggatagtctactggctcaaattggagatcagtatgctgatttattcttagcggctaaaaatttatcagatgccattcttttgtcagatattttgacagaaagtgacgagataactagagcacctctgtcagcgtctatggtaaaacgttatcgtgagcatcacaaggacttggtcactttgaaaacattaataaaggatcagttaccggagaagtaccaggaaatttttttagataagactaaaaatggttatgctggatatattgagggacaagttagccaggaggaattttacaaataccttaagcctattttagcaagattggatggatcggaaccgttacttctaaaaattgaccgagaagactttttgagaaagcaacgaacctttgataatggctctattcctcaccaaattcatttagaagaattacacgctattttgagaagacaagaagtcttctacccatttttaaaagataatagaaagaaaattgaatctcttttaacgtttagaataccttattatgtgggtccgttggctcgtggtcatagtcgctttgcatgggtaaagcgaaaattcgatggggctattagaccctggaattttgaagagattgttgatgaagaagcttccgcacagatctttattgaaaaaatgactaaaaatgatctctacttgccaaatgaaaaggttcttcctaagcatagcctattatatgaaacttttacagtttataatgagctaacaaaggtcaaatatgctactgaaggaatgacacgtcctcaatttttatctgctgatcagaaacaagctattgttgacttattgtttaaaacaaatcgtaaagtgactgttaaacaattaaaagagaactattttaaaaagattgagtgctgggatagtgttgagattactggggttgaagatagcttcaatgcttcacttgggacctatcatgacttgttaaaaatcattcaggataaggattttttagataatcctgacaaccagaaaatcattgaagatattattttgaccttaacactttttgaagataaaaaaatgatttcaaaacgattagatcaatatgcacatctctttgataaagtcgtattgaataaactggagaggcatcactataccggttgggggcgtttatcaggaaagcttataaatggtattcgagacaaacaatcaggaaaaacaattttagattttctaaaggctgatggttttgccaatcgaaactttatgcagttaattcatgatagtgaactaagctttatagatgagattgctaaagcccaagtgattggaaaaactgagtattcgaaagacctggttgggaatttagcgagtagtccggctattaaaaaaggtatttcacaaacaattaaaatcgttgatgagctggtcaaaatcatgggctatctcccgcagcagattgttattgaaatggcacgtgaaaatcagactacagctcaaggaattaaaaatgctcgtcaacgcatgagaaagctagaagagactgccaaaaaattgggtagcaatattctgaaggagcaccctgttgataatagtcaattgcaaaatgataagcgttacctctattatcttcaaaatggaaaggatatgtatacgggtgatgacttagatattgattatttgagtagctatgacattgatcatatcattccgcagagctttattaagaataattccattgataacaaggtattaacctcacaaggcgctaatcgaggaaaattagataatgttcctagtgaggctattgttaggaaaatgaaaggctattggcaatccttattgagagcaggagctatctcaaagcaaaaattcgataatctgacaaaagcagaacgtggaggtttaactcaagtagacaaagccggctttatccaacgtcaattagtggagacacgccaaatcacaaaacatgtggcacaaatcttagatagtcgcttcaatactgaatttgatgatcataataagcgtattcgaaaggttcatattataacgctaaaatcaaagctggtttctgatttccgtaaagagtttggtttgtataaaattcgtgatatcaatcattatcatcatgctcatgatgcataccttaatgctgttgttgccaaagcgatactaggtaagtatcctcaactagctccagaatttgtttatggagattaccccaaatataatagctttaaggaacgccagaaagcaactcaaaagacgttattctattcaaatatcttaaaattctttaaagatcaagaaagtcttcatgttaactctgatggtgaagaaatatggaatgccaataagcatttacctattattaaaaatgttctttcgattccgcaggttaatatcgtcaagaaaacggaagtacaaacagggggcttctataaagagtccattttgtctaagggtaattctgataagctgatcccaaggaaaaataactgggataccaggaagtatggtggctttgatagtccaactgtagcttattctgttttggtgatagctaaaatggaaaagggaaaagcaaaagtattaaagccagtgaaggaaatggttggtattaccattatggagaggatcgcatttgaagaaaatcctgtagtctttttagaagcaaaaggctatcgagaaattcaagagcatctcattataaaactccctaaatatagcttgtttgaattagaaaatggaagaagacgtttattggcaagtgctagtgaactacaaaaaggaaatgaattgtttcttccagttgattatatgacatttctatatttagctgctcattaccatgagctaactggatcctcagaggatgttttgaggaaaaaatattttgtagagaggcatttgcattattttgatgacattattcaaatgattaatgattttgcagagcgtcatattcttgctagtagtaatttagagaaaataaaccatacatatcacaataattctgaccttccaattaatgaaagagcagagaatataattaatgtgtttactttcgtagccctaggagcacctgcagcctttaaattttttgatgcgactattgatcgaaaacgatatacctcaactaaggaagtgctaaatgccactctcattcatcaatctgttactggtttgtatgagacgcgaattgatttgagtcaattaggagagaactaa

SEQ ID NO: 373 - DNA, 3411 bp, Streptococcus gordonii Challis substr CH1
atgaacggtttagttttaggtttagatattggtattgcctctgtaggggtggggattctagaaaaagatacggggaagatcattcatgctagttctcggctttttccagctgcaactgccgacaataatgtcgaaagaaggagtaatagacagggaagacgattaaatcgcaggaaaaaacaccgtagtgttaggcttcaggatctatttgaaggctatggtttgttaactgatttttctaaagtgtcaatgaatttaaatccttatcaacttcgtgtacaaggaatggagaatcaactcacaaacgaagagttgtttgttgcattgaagaatattgttaaaaggcgtggtattagctatttagatgatgcttctgaggatgggggtacagtatcgtctgattatggtaaggcagttgaagaaaatagaaaattacttgctgaaaagacacctggtcaaatccaactagagcgttttgaaaaatatggtcaattaaggggagattttactgttgaagaaaatggtgaaaaacatcgattgatcaatgtcttttcaacatctgcttatagaaaagaagctgaaagaattcttagaaaacagcaagaatttaatagtaaaattactgatgagtttatagaggattatttaataatccttacagggaaaagaaaatattatcatggaccaggtaatgaaaaatctcggacagattatggacgttttcgaacagatggtactaccttagataatatttttggtattttaattggcaaatgtacattttatactgaggaatatagagcttcaaaagcctcctatactgctcaagagtttaatttactaaatgatttaaataatttaacagttcctacagagaccaagaaacttagtgaggaacaaaagaagctaatcattgaatatgcaaagtcggcgaaaacattaggagcttcaactttattgaagtacattgctaaaatgattgatgcttcagtagatcagatacgtggttaccgagttgatgtaaataataaacctgaaatgcatacttttgaagtctatcggaaaatgcaatctttagaaacgataaaagttgaagaattgcctagaaaagttctagatgagcttgctcatattctaactttgaatacagagcgagaaggtatagaagaagcgattaactcgaagttaaaggatatatttaatcgagatcaagtacttgaattggttcaatttagaaaaaataatagcagtctatttagtaaaggatggcataatttttctattaaactcatgatggagttgataccagaactttatgaaacttcagaagagcaaatgacaattctcacacgattgggaaaacaaagatctaaagagacatcaaaacgaactaagtatattgatgaaaaagaattaacagaagaaatctataatcctgtagtagcaaaatctgttagacaggccataaagataatcaacgaagcaactaaaaaatatggtatctttgataatatcgttatcgaaatggcccgtgaaaataacgaagaagatgctaagaaagattatataaaacgtcaaaaagcaaaccaagatgagaagaatgcggctatggaaaaagcagcgtttcaatacaatggtaaaaaagagttaccagataacatttttcatggccataaggaattgactactaagattcgtttatggcatcaacagggagaaaagtgtctctatactgggaagaatattccaatttcagatttaatccacaatcagtacaagtacgaaatcgatcatattttacctttatctctatcttttgatgatagtttatctaataaagtattagttctagctactgcaaaccaagaaaagggacaacgaacaccgtttcaggctttagatagtatggatgatgcatggtcctaccgtgagtttaaatcatatgtaaaagattcaaaattattaagtaataaaaagaaagattatcttttaacagaagaagacattagtaaaattgaggtgaagcagaagtttattgaacgaaatctagttgatactagatattcttctcgagttgttttaaatgccttgcaagatttttataagagccatcaattggatacaactatttcggtggtacgtggacaatttacctctcagctaaggagaaagtgggggattgaaaaatctcgtgagacctaccaccatcatgctgtggatgcattaattattgctgcttccagtcaattaagattatggaaaaaacatagtaatcctctgattgcttataaagaagggcaattcgttgattcagagactggagaaatcgtttcattaagtgatgaagaatacaaagagttagtatttaaagcaccttatgatcattttgttgacacattacgtagtaagaagtttgaggatagcattttgttttcatatcaagtggattcaaaatataaccgtaaaatttcagatgcgaccatttatgcaacaagaaaagcaaaattggataaagagaaaaaagaatatacttatactttggggaaaataaaagatatctatgctttagggacaaaaactccgtctaaaacaggattttataagtttttagatttatacaagacggataaatctcaattcttaatgtatcagaaggataggaaaacttgggatgaagtaatagagaagataattgaacaatatcgaccatttaaagaatatgacaaaaatggaaaagaggttgatttcaatccttttgaaaaatatagaattggaaatggtcctattcggaaatatagtaaaaaagggaatggtccagaaattaaaagtctgaaatactacgatatattattaggtaaacacaaaaatataactcctgatgggagtcgaaatactgtagctttgttatctttaaatccttggagaacagatgtttactacaattcggaaactaaaaaatatgaatttttgggattaaagtatgcagatttgtgtttcgaagaggggggagcctatggtatttctgaagttaagtataaaaagataagagagaaagaaggaattggtaagaattctgaatttaagtttaccctgtataagaatgatttaattttaattaaagatactgaaacgaattgtcaacaattctttagattttggtctcgtactgggaaagataatccaaaaagttttgaaaaacataaaatagaattgaaaccttatgaaaaagcaaaatttgagaaaggagaagaacttaaagtattaggaaaggtaccaccttcctctaatcaattccaaaaaaatatgcaaatagaaaatctttctatttacaaagtcaaaacagatattttaggaaataaacatttcatcaaaaaagagggtgatgaaccaaaactcaaatttaaaaaataa

SEQ ID NO: 374 - DNA, 3390 bp, Streptococcus infantarius subsp infantarius
atgagtaatggaaaaattttaggcttggatattggtgtagcttccgttggtgttggtattattgattcaaaaacaggaaatgtaatacatgccaattcgcgtttattttctgctgcaaatgctgaaaataatgctgaaaggagaggttttcgcggtgcaagacgtttaacccgtcgtaaaaaacatcgtgtaaaacgtgttcgtgatttatttgaaaaatatgatatttcaactgattttagaaatctaaatttaaatccgtacgaacttcgtgttaaagggttaacggaacaattaacaaatgaagaattgtttgctgctttgcgtacaattgcaaaaagacgcggcatttcatatcttgatgatgcagaagatgattcaacaggtagttcagattatgcaaaatctattgatgagaatcgtcgtttgttgaaaactaaaactccaggtcaaattcaattagaacgattggaaaaatatggtcaattacgtggaaacttcacagtgtatgatgaaaatggtgaagctcatagactaattaacgttttctctacttctgattataagaatgaagcacgtaaaattttagaaactcaatcaaactataataaacaaattacagatgagtttattgaagactatattgaaatcctaactcaaaaaagaaaatattaccatgggccaggtaacgaaaaatctcgtacagattacggacgttttcgtacagatggaacaaccttggagaatatctttggaattttgattggaaaatgtagtttttatcctgaagaataccgtgcttctaaagcttcatatactgcgcaagagtttaactttttaaatgatttaaataatttaaaagttcctactgaaactggtaaattgtctactgagcagaaagagtatttagtagattttgctaagaaatcaaaagcactcggtgcttctaaattattaaaagaaattgcgaagatagtagattgtagtgtagatgatattaagggctatcgagtagataataaagataagccagatttgcatacttttgagccttatcgtaagttaaaatttaatttaagttcaattgatattgatgaactatcaagagaaacattagataaactggcagatattttaacgcttaatacagaacgtgagggtattgaagatgctatcaaacgcaatcttccaagtcaatttaccgaagaacaaatttctgaaattgtccaaattaggaaaaatcaaagttcagcattcaataaaggttggcatagcttttcagctaaattgatgaatgaattaatccctgaactgtatgtaacatctgaagaacagatgacaattttgacaagactagaaaaattcaaggttaataaaaaatcatcaaaaaatacaaaaacaattgatgaaaaagaaataacagatgaaatttataatcctgttgtagcaaaatcagttcgacaaacaattaaaatcattaatgcggctgttaagaaatatggcgattttgataagattgttatcgagatgccacgagataagaatgctgaagatgagaagaaatttattgataaaaagcaaaaagaaaataaaaaagaaaaagatgattctttaaaacgagcagcttttctttataatggtactgataacttacctgatggcgtttttcatggcaataaagagttaaaaactaaaattcgcctttggtatcaacaaggtgagcgttgtttatattctggtaagctaatttctattcatgatttagtgcataattcaaataagtttgagattgatcatattttgcctctatcactttcttttgatgatagtttagctaataaggttttagtgtatgcttggactaaccaagagaagggacaaaaaactccttatcaagttattgattctatggatacggcatggtcatttagagaaatgaaagattatgtcttaaaacaaaaagggcttggtaagaaaaaatgtgaatatcttttaacaacagaaaatatcgataaaatcgaagttaaaaagaaatttatcgaacgtaatcttgtggacactcgttatgcttcacgagtagtgcttaatagtcttcaaacagcattaaaagagttggggaaagatactaaagtttctgttgtcagaggtcagtttacatcacagctccgccgaaaatggaatattgataaatcgcgcgaaacataccaccatcatgctgttgatgctttaattattgctgcttcaagtcaattgaaattgtggcaaaaacaagaaaatccgatgtttgagagctatggtgaaaatcaagtggtgaataaagagactggtgaaattttaagtatctctgatgataaatataaagaattagttttccaaccaccttatcaaggatttgtaaatacgatttcaagtaaaggatttgaggatgaaattttattctcttatcaagttgattcaaaatttaatcgtaaagtctctgatgctactatttactcaacacgaaaagctaaacttggaaaagataaaaaagatgaaacttatgttttagggaagataaaagatatctacagtcaagatggttttgatacttttattaaaagatataaaaaagataaaacacaattcttgatgtatcaaaaagatcctctaacttgggaaaatgttattgaagttattctcagagattatccaagtgaaaaactttccgaagatggtaaaaaaactgtaaaatgcaatcctttcgaagagtatcgtagagaaaatggcttaatctgtaaatacagtaaaaaaggaaatggaacaccaattaagtctcttaagtattatgataaaaaattaggaaattgtattgatataacacctgaaaaatctaaaaatagagttgtattgagacaaatttctccatggcgagctgatatttactttaatctagagactttaaaatatgaactgatgggattgaaatattctgatttaagttttgaaaaaggaactggtaagtatcatatctcacaagaaaagtatgatgcgataagggaaaaagaaggtatcggcaaaaaatcagaatttaagtttactctttaccgaaatgatttgattttaatcaaagatactctaaataattgtgaaaggatgttaagattcggctcaaaaaatgatacatctaagcactatgtggaattaaaaccattagaaaaaggaacttttgattctgaggaagaaattttaccagttttgggaaaagttgcaaaaagtggacagtttattaaaggtttaaataaacctaacatatcaatctataaagttcgaacagatgttcttggtaataaattctttattaaaaaagaaggtgataaacctaagttagattttaaaaataataacaaataa

SEQ ID NO: 375 - DNA, 3378 bp, Streptococcus intermedius B196
atgaacggtttggttttaggattggatatcggtattgcttctgtcggagtgggaattttaaataaagaaacaggtgaaattattcacgttaattcgagaatttttccagctgcaaccgcagacagcaatgtagaacgtcggggatttagacaaggaagaagacttggtcgaaggaagaaacatcgcagcgctcgcttaaacgacctttttgaagaattcggttttataacagatttttctgctgtccctttaaatttaaatccttatgctctgcgtgtgaagggattaagcgaagaattaacaaatgaagagttgtttattgcgcttaaaaacattattaaacggcgtggtatcagctatctggatgatgctagtgaagatggagaaacagcttccaatgagtatggaaaagcagttgaagaaaacagaaaattacttgcagacaaaacgcctggacaaatccagttggaacgttttgaaaaatacggacaagttcgtggggattttacagttgttgaaaatggggagaatcatcgtttgattaatgtattttctacttcagcctacaaaaaagaagcagagcgaattcttagaaggcaacaagaattcaatgtgaggatttcagatgaattcattgaagcttatttaactattttgactggcaaaagaaaatattatcatgggcctggaaatgaaaaatctagaacagattatggaagatttcggacagatggcacaactcttgataatattttcggtattttaattggaaaatgtactttttatcccgatgaatatcgagcagcaaaggcgtcatataccgcgcaggaatttaatttgctcaacgacctcaataatttaacagttccaactgaaacgaaaaaattaagaccagaacaaaagcggcagattgtcgagtatgctcgaactgcaaaaactttaggaactccaactttactgaaatatattgctaagttagtagatggttctattgatgacataaaaggatatcggattgataaatctgataaaccggagatgcatacttttgacgcctatcgtaaaatgagaacactagaactggtggatgtagatatattatcaagagaaaccttagatgatttagcgtacattctaaccttgaacacagaaagtgaaggtattttagaagctcttaacagtaaaatgcctggtacatttaccaaagagcagattgatgagttaattcagtttaggaagaaaaacagtgcggtatttggaaaaggttggcataatttttctcttaagttaatgaatgaattgattccggagctttatgagacttcagaggagcaaatgactattttgactcgtctaggtaaacaaagaagtagagaaatttcaaaacgaactaaatacatagatgaaaaagaattaacagatgaaatttataaccctgttgttgccaaatctgtccgtcaggctattaaaatcatcaacttagcgaccaaaaaatatggcatttttgataatattgtcattgaaatggcgcgtgaaagcaatgaagatgatgagaaaaaagcaattcaaaacgtccaaaaagccaatgaagatgaaaagaaagcagcaatggaaaaagctgctgatctatacaatggtaaaaaagagttaccagacagtatttttcatggacacaaagagttagcaaccaaaattcgcctttggcatcaacagggagaacgctgcctttatacaggaaagaacatctctattcatgatttaattcataatccacaccagtatgaaattgatcatattctgccgctttcactttcttttgatgatggcttagccaataaggttctggtgctagcaacagctaatcaggaaaagggacagagaacaccattccaggctttagatagtatggatgatgcgtggtcttacatagagttcaaacaatatgtccggaattctaaaagcttaagtaataagaaaaaagactatctgctgaccgaagaagatatcagcaagattgaagtaaaacaaaaattcattgagcgcaatctcgtggacacacgttactcatcacgggtagtcctaaatacgttgcaggaattttacaaaacaaatgatttcgatacaaaaatttcggttgttcgtggtcaatttacatcacaactgagaagaaagtggaaaattgaaaaaagtcgtgatacctatcaccaccacgcagtagatgctctcatcatcgcggcctccagtcagttgagactctggaaaaagcagaataatcctttgatttcttatagagaagggcagcttgtagatcctgaaacgggagagattctttcactgacagatgacgaatataaggaacttgttctcagaccaccatatgattattttgtagatacattgaagagcaaatcgtttgaagacagtatcttgttttcttatcaagtggattctaaatataaccgaaaaatatcagatgctacaatctatggaactagaaaagctcagttggggaaagataagcaggaggaaacttatgtacttggaaaaattaaggatatctattctcaaaagggctatgaagattttatcaagagatataagaaagatacaactcagttcttgatgtatcacaaagatccacagacctttgcaaaagttattgaagaaattcttaaaacctatcctgacaaagagttaaacgaaaagggtaaagaaattccctgcaatccttttgaaaagtacagacaagaaaatggccctattcgaaaatacagcaaaaagggcaaaggcccagagattaaaagccttaagtattatgataataaacttggcaatcacattgatattactcctgtaaacagtcagaaccaggttgttttgcagtccttgaagccttggcggacagatgtttattttaatccccagacttccaaatatgaattgatgggattgaaatattcagatttaagatttgaaaaagggagtggaagctacggtatttcacctgaaaaatataataaagtcaaagcaaaagaaggagtggacgaggattcagaatttaaatttactttatataagaacgatttgattttgataaaagacaccgaaactggagagcagcaattatttaggtatggttcgcgaaacgatacctcaaaacattatgttgagttaaaaccttatgaaaaagcgaaatttgaaggaaatcaacagctgatgaatttgttaggaaccgttgcaaaaggtggtcaatgcctcaaagggataaacaagcctaatctctccatctataaagtcaaaacagatgttcttggtaataaatattttattaaaaaagagggtgatcagccacagctcaattttaagaaaaaaatttaa

SEQ ID NO: 376 - DNA, 4122 bp, Streptococcus lutetiensis 033
atggaaaaaacatattcaatcggactcgatatcggaacaaacagtgtgggttggagcgtaattaccgatgattacaaagttccagctaaaaagatgaaagtcttaggaaatactgataaaaagtatattaagaagaacttattaggtgcactgttatttgatagtggtgaaactgctgaagtaactcgtttaaaacgtacagctagacgtcgctacacacgccgtaaaaatcgtttacgttatttgcaagaaatttttgctaaagaaatggcaaaagttgatgaaagtttctttcaacgtttagaagaatcatttctgacagatgatgataaaacctttgattcccatccaatttttggaaataaagccgaagaagatgcttatcatcaagagtttcctacaatttaccatttgagaaaacatcttgcagattcatctgaaaaagcagatttacgcttggtttatctagctttagctcatatgattaaattccgtggacatttcttaattgagggtgaattgaacgctgaaaatacagatattcaaaagttattcaatgattttgttgaaacatatgataagattgctgatgaaagtcatttgtcggaagttgatgcttcaagtatcctaactaacaaaattagtaaatcacgtcgtttggaaaatcttattaaacaatatccaacagaaaagaaaaatactttatttggaaatcttgtagcattagttttaggattgcaacctaacttcaaaacaaactttaaattatccgaagatgcaaaattacaattttctaaagatacttatgatgaagatttggaagaattgttggggaaaattggtgatgactatgctgatctttttacagcagctaaaaatctatatgatgcaattttactttcaggtatcttaacagtagatgataattcaactaaagcaccattatctgcttcgatgattaaacgctatgaagagcaccatgaagatttagaaaagttaaaaaaatttattaaagtgaataattttgataagtatcatgagatttttaaagataaaagtaaaaatggttatgctggatatattgaaaatggtgttaagcaagatattttttataaacatcttaagagcattatttctgagaaaaacggaggtcaatatttccttgataaaattgaacgtgaagattttttgagaaaacaaagaacgtttgataatggctctattccacatcaaattcatttacaagaaatgcgtgctattttacgacgtcaaggtgagtattatccattcttaaaagaaaatcaagctaaaattgaaaaaatattaacttttagaatcccttactacgtaggtccattagcaagaaaagatagtcgttttgcttgggctaattaccattcagatgagccgattacaccgtggaattttgatgaagtggtggataaagaaaaatcagctgaaaagtttatcacacgaatgactttaaatgatttatatttacctgaagaaaaggttttaccgaaacacagtcatgtatatgaaacatttacggtttataatgaattaacaaaaattaagtatgttaatgaacaaggtgagtcgtttttcttcgatgcaaatatgaagcaagaaatctttgaccacgtatttaaagaaaatcggaaagttacgaaagctaaacttttaagctatcttaataatgagttcgaagagtttcgaatcaatgatttaattggtcttgataaagatagtaaatcatttaatgcaagccttggaacttatcatgatttgaaaaagattttggataaatctttcttagatgataagacaaatgaacaaatcattgaagatattgtgttgactttgaccttatttgaagatagagatatgattcatgaacgtcttcaaaaatacagtgatttctttacttcgcaacagttgaagaaacttgaacgtcgccattatactggttggggacgtctatcatataaactgattaatggaattcgcaataaggaaaataacaaaactattcttgatttcttgattgatgatggtcatgctaaccgcaattttatgcaattgattaacgacgagtcattatcatttaaaactattattcaagaagcacaagttgtaggtgatgtcgatgatattgaagctgttgttcatgatttacctggaagtcctgctattaaaaaaggtattctacaaagtgtcaaaatcgttgatgagctagttaaagtgatgggagataaccctgataatattgttattgaaatggcgcgtgaaaatcaaacaactaatagagaaagaagccagtcccaacaacgtttgaaaaaacttcagaactcattaaaagagttaggaagtaatattcttaatgaggaaaaaccgtcatatattgaagataaggttgaaaatagtcatcttcaaaacgatcaactcttcctttactacattcaaaatggtaaagatatgtacactggtgatgagttagatattgaccatctaagcgattatgatattgaccacattattcctcaagcctttattaaggataactctattgataatcgagtactaacaagttctgctaaaaatcgaggtaaatcagatgatgtaccaagtcttgatattgttcgtgctagaaaggcagaatgggttcgattgtataaatcaggactaatctctaaacgtaaatttgataatttaacgaaagccgaacgtggtggattaactgaagctgataaagccggatttattaaacgccaattagttgaaacacgtcaaatcacaaaacatgtcgcacaaattttagatgcccgttttaatacaaaacgtgatgaaaatgacaaggtgattcgtgatgtaaaagtcattactttgaaatcaaacttagtttcgcaattccgaaaagaatttaaattctataaagttcgtgaaattaatgattatcaccacgctcacgatgcttatctcaacgcagtagttggaacagctttgcttaaaaaatatccaaaattaacaccagaatttgtatacggtgagtataaaaaatatgatgttcgtaaacttattgccaaatcttctgatgactattctgaaatgggtaaagcaacagcaaaatatttcttctattcaaatttgatgaacttctttaaaactgaggtcaaatatgcagatggtagagtatttgaacgaccagatattgagacaaatgcagatggtgaagttgtctggaataagcaaaaagattttgacattgttcgaaaagttctgtcataccctcaagttaatattgttaagaaggtagaagagcagacagtcggacaaaatggtggtttatttgataataatatcctagccaaacctgaaaaagatgataagaaaaaattatttccaattaaaaaatcactttctacaacttcatatgggggatatgctagagctacaatagcttattctattttgattgttagtgaatttggtaaaaataaagaattgaaattactaggtctaccacttcttgataaagtaaaatatgagaaaaatcctattgcatatttaaatagtattggaataataaatgtaaaaagtatctttaaacttcctaagtactgtttatttgaatttcaagaaaagaacactaattatcgtagatatatggtaagtaatcaggaattaaaaagggctaatcaattgtttttaacatgtaaagagactgagttagtatacaagtatataaaaagtgataacgacaatacacatttagttggtaatgaaaagacaatattatctatctggaataaattggttatttttatggaaagaactaaattaattgataagaaattgtttgcgtcgttgaaacaattaaaagacgaagttgacttaataaatattttagatatgactgctaaatcattggattttactaaaattagtgcaggacagaagaaaatcacaataagtgattctttatcgttaccaatcaagcgatggcaattttctagtgatgaaaaaatgttaaaacaattaaagactgccacccttatccaccaatctgtcactggcctttatgaaacacgtattgatttgagtaaattaggagaagagtaa

SEQ ID NO: 377 - DNA, 4179 bp, Streptococcus mitis SK321
atgaacaataacaattactctatcggactcgatatcggaacaaacagcgtcggatgggccgtcattacggatgactataaggtgccatcgaaaaagatgaaagttctaggcaatacagataaacactttatcaagaaaaatctaattggagctttattatttgatgaaggagctactgctgaagatagacgtttcaaacgaacagcacgccgtcgctatactcgtcgaaaaaatcgtcttcgctatcttcaagaaatcttttctgaggaaatgagcaaagtggatagtagtttctttcatcgattagatgactcattcttagttcctgaggataaaagaggaagtaaatatcctatttttgctaccttggcagaagaaaaagaatatcacaagaaatttccaactatctatcatttgagaaaacaccttgcggactcaaaagaaaaaactgacttgcgcttgatctatctagcattagcgcatatgattaaataccgcggacattttttgtatgaagaatctttcgatattaaaaacaatgatatccaaaaaatctttagcgagtttataagcatttacgacaacacctttgaaggaagttcacttagtggacaaaatgcacaagtagaagcaatttttactgataaaattagtaaatctgctaagagagaacgcattctaaaactctttgcttatgaaaaatccactgatctattttcagaatttctcaagctgattgtaggaaatcaagctgattttaagaaacactttgacttggaagaaaaagctccactacaattctctaaagatacctatgatgaggatttggaaaacttactcggacaaattggagatgactttgcagaccttttcctagttgctaaaaaactctatgatgccattcttttatcaggaatcttaactgttacagattcttcaactaaggccccactatcagcatctatgattgagcgctatgaaaaccaccaaaaagacttagcggctttaaaacaattcatccaaaacaatcttcaagaaaaatatgatgaagttttctctgaccaatctaaagatgggtatgctaggtatatcaatggcaaaaccactcaagaagcattttacaagtacatcaaaaatcttctctctaaattcgaaggatcagattatttccttgataaaattgaacgtgaagatttcttgagaaaacaacgcacctttgataatggttctatccctcatcaaattcatcttcaagaaatgaatgccattatccgtcggcaaggagaacattatccatttctgaaggaatataaagaaaagatagagacaatcttgactttccgtattccttattatgttggcccattggctcgtggaaatcgtaattttgcttggcttactcgaaactctgaccaagcaatccgaccttggaattttgaagaaattgttgatcaagcaagctctgcggaagaattcatcaataagatgactaactatgacttgtatctgccagaggaaaaagttttgcccaagcatagtctcttgtatgaaacatttgctgtctacaatgaattaacaaaagtaaaatttatttcagagggattgagagactatcaattccttgatagtgggcaaaagaagcaaattgtcaatcaattattcaaagagaaaagaaaagtaactgaaaaagacatcattcagtatctacacaatgttgatggctacgatggaatcgaactaaaaggaattgaaaaacaatttaacgctagtctttctacttatcatgatttactcaaaataatcaaggataaagagtttatggatgatcctaaaaatgaagagattcttgaaaatatcgtccacacactaactatctttgaagatcgtgagatgatcaagcaacgccttgctcaatatgcctctatctttgataaaaaagtgatcaaggcactgactcgtcgacattatactggttggggaaaactctctgctaagctaatcaacggtatctgtgataaaaaaactggtaaaacaattcttgactacttgattgatgacggctacagcaatcgtaactttatgcagttaatcaatgatgacgggctttccttcaaagatattattcaaaaagcacaagtggttggtaagacaaacgatgtgaagcaagttgtccaagaactcccaggtagtcctgctattaaaaagggaattttacaaagtatcaagcttgtcgatgagcttgtcaaagttatgggccatgctcccgagtccattgtgattgaaattgcacgagaaaatcagacaactgccagagggaaaaagaattctcaacaaagatataagcgcattgaagatgcactaaaaaatttagcacctgggcttgattcaaatatattaaaagaacatccaacagataatattcaacttcaaaatgaccgtctcttcctttactatctccaaaatgggaaggatatgtacactggagaagctcttgatatcaaccaactgagcagctatgacattgaccacatcgtcccacaggcctttatcaaggatgattctcttgataaccgtgtcttgactagttcaaaggataatcgtgggaaatccgataatgttccaagtttagaagtcgttcaaaaaagaaaagctttttggcaacaattactagattccaaattgatttcagaacataaatttaataatttaaccaaggctgaacgtggtgggctagatgagcgagataaagttggctttatcagacgccaactagttgaaacacggcaaatcacaaaacatgttgctcagattttggatgcccgttttaatacagaagtgaatgagaaagataagaagaaccgtaccgtcaaaattatcactttgaaatccaatctagtttccaacttccgtaaagaatttaagttatataaggtacgcgaaatcaatgactaccaccatgcacatgatgcctatttaaatgcagtggtggctaaggctatccttaagaaatatcctaaactagagcctggattcgtctatggtgactatcaaaagtacgatattaagagatatatttccagatccaaagatcctaaagaagttgaaaaagcaactgaaaagtatttcttctactcaaacttgttgaacttctttaaagaagaggtgcattacgcagacggaaccatcgtaaaacgagagaatatcgaatactctaaggacactggggaaatcgcttggaataaagaaaaagatttcgctacaattaaaaaagttctttcacttccgcaggtgaatattgtgaagaaaacagagattcaaacacatggtctagatagaggtaaacctagaggattgttcaattccaatccatctcctaaaccttcagaagatcgtaaagaaaaccttgtcccaattaaacaagggcttgacccacgaaaatacggtggttacgctggtatttctaactcatacgcggtcttagttaaagctattattgaaaaaggagcgaaaaaacaacaaaagaccgttcttgaatttcaaggtatctctattttagataaaataaattttgaaaagaacaaagaaaactatcttcttgaaaaaggatacataaaaattctatcaactattactttacctaaatatagtttgtttgagtttcctgatggtacaagaagaagactagcaagtattctatcgacaaacaataaacgaggagaaattcataaaggtaatgaattggtcatccctgaaaagtatacgactcttttgtatcatgctaagaatattaataaaacacttgaaccagaacacttagagtatgttgagaaacatcgaaatgattttgctaaacttttagaatatgtacttaactttaacgataagtatgtaggcgcattaaaaaatggagaaagaatcagacaagcatttattgattgggaaacagttgatattgaaaagttatgtttcagtttcattggtccaagaaatagtaaaaatgctggtttattcgagttaacttcacaaggaagtgcttctgacttcgagttcttgggagtaaaaattccacgatacagagactatacaccttcgtcactcctcaacgccaccctcatccaccaatccatcactggtctttacgagactcggattgacttaagcaaactgggagaagactga

SEQ ID NO: 378 - DNA, 4038 bp, Streptococcus mutans UA 159
atgaaaaaaccttactctattggacttgatattggaaccaattctgttggttgggctgttgtgacagatgactacaaagttcctgctaagaagatgaaggttctgggaaatacagataaaagtcatatcgagaaaaatttgcttggcgctttattatttgatagcgggaatactgcagaagacagacggttaaagagaactgctcgccgtcgttacacacgtcgcagaaatcgtattttatatttgcaagagattttttcagaagaaatgggcaaggtagatgatagtttctttcatcgtttagaggattcttttcttgttactgaggataaacgaggagagcgccatcccatttttgggaatcttgaagaagaagttaagtatcatgaaaattttccaaccatttatcatttgcggcaatatcttgcggataatccagaaaaagttgatttgcgtttagtttatttggctttggcacatataattaagtttagaggtcattttttaattgaaggaaagtttgatacacgcaataatgatgtacaaagactgtttcaagaatttttagcagtctatgataatacttttgagaatagttcgcttcaggagcaaaatgttcaagttgaagaaattctgactgataaaatcagtaaatctgctaagaaagatagagttttgaaactttttcctaatgaaaagtctaatggccgctttgcagaatttctaaaactaattgttggtaatcaagctgattttaaaaagcattttgaattagaagagaaagcaccattgcaattttctaaagatacttatgaagaagagttagaagtactattagctcaaattggagataattacgcagagctctttttatcagcaaagaaactgtatgatagtatccttttatcagggattttaacagttactgatgttggtaccaaagcgcctttatctgcttcgatgattcagcgatataatgaacatcagatggatttagctcagcttaaacaattcattcgtcagaaattatcagataaatataacgaagttttttctgatgtttcaaaagacggctatgcgggttatattgatgggaaaacaaatcaagaagctttttataaataccttaaaggtctattaaataagattgagggaagtggctatttccttgataaaattgagcgtgaagattttctaagaaagcaacgtacctttgacaatggctctattccacatcagattcatcttcaagaaatgcgtgctatcattcgtagacaggctgaattttatccgtttttagcagacaatcaagataggattgagaaattattgactttccgtattccctactatgttggtccattagcgcgcggaaaaagtgattttgcttggttaagtcggaaatcggctgataaaattacaccatggaattttgatgaaatcgttgataaagaatcctctgcagaagcttttatcaatcgtatgacaaattatgatttgtacttgccaaatcaaaaagttcttcctaaacatagtttattatacgaaaaatttactgtttacaatgaattaacaaaggttaaatataaaacagagcaaggaaaaacagcattttttgatgccaatatgaagcaagaaatctttgatggcgtatttaaggtttatcgaaaagtaactaaagataaattaatggatttccttgaaaaagaatttgatgaatttcgtattgttgatttaacaggtctggataaagaaaataaagtatttaacgcttcttatggaacttatcatgatttgtgtaaaattttagataaagattttctcgataattcaaagaatgaaaagattttagaagatattgtgttgaccttaacgttatttgaagatagagaaatgattagaaaacgtctagaaaattacagtgatttattgaccaaagaacaagtgaaaaagctggaaagacgtcattatactggttggggaagattatcagctgagttaattcatggtattcgcaataaagaaagcagaaaaacaattcttgattatctcattgatgatggcaatagcaatcggaactttatgcaactgattaacgatgatgctctttctttcaaagaagagattgctaaggcacaagttattggagaaacagacaatctaaatcaagttgttagtgatattgctggcagccctgctattaaaaaaggaattttacaaagcttgaagattgttgatgagcttgtcaaaattatgggacatcaacctgaaaatatcgtcgtggagatggcgcgtgaaaaccagtttaccaatcagggacgacgaaattcacagcaacgtttgaaaggtttgacagattctattaaagaatttggaagtcaaattcttaaagaacatccggttgagaattcacagttacaaaatgatagattgtttctatattatttacaaaacggcagagatatgtatactggagaagaattggatattgattatctaagccagtatgatatagaccatattatcccgcaagcttttataaaggataattctattgataatagagtattgactagctcaaaggaaaatcgtggaaaatcggatgatgtaccaagtaaagatgttgttcgtaaaatgaaatcctattggagtaagctactttcggcaaagcttattacacaacgtaaatttgataatttgacaaaagctgaacgaggtggattgaccgacgatgataaagctggattcatcaagcgtcaattagtagaaacacgacaaattaccaaacatgtagcacgtattctggacgaacgatttaatacagaaacagatgaaaacaacaagaaaattcgtcaagtaaaaattgtgaccttgaaatcaaatcttgtttccaatttccgtaaagagtttgaactctacaaagtgcgtgaaattaatgactatcatcatgcacatgatgcctatctcaatgctgtaattggaaaggctttactaggtgtttacccacaattggaacctgaatttgtttatggtgattatcctcattttcatggacataaagaaaataaagcaactgctaagaaatttttctattcaaatattatgaacttctttaaaaaagatgatgtccgtactgataaaaatggtgaaattatctggaaaaaagatgagcatatttctaatattaaaaaagtgctttcttatccacaagttaatattgttaagaaagtagaggagcaaacgggaggattttctaaagaatctatcttgccgaaaggtaattctgacaagcttattcctcgaaaaacgaagaaattttattgggataccaagaaatatggaggatttgatagcccgattgttgcttattctattttagttattgctgatattgaaaaaggtaaatctaaaaaattgaaaacagtcaaagccttagttggtgtcactattatggaaaagatgacttttgaaagggatccagttgcttttcttgagcgaaaaggctatcgaaatgttcaagaagaaaatattataaagttaccaaaatatagtttatttaaactagaaaacggacgaaaaaggctattggcaagtgctagggaacttcaaaagggaaatgaaatcgttttgccaaatcatttaggaaccttgctttatcacgctaaaaatattcataaagttgatgaaccaaagcatttggactatgttgataaacataaagatgaatttaaggagttgctagatgttgtgtcaaacttttctaaaaaatatactttagcagaaggaaatttagaaaaaatcaaagaattatatgcacaaaataatggtgaagatcttaaagaattagcaagttcatttatcaacttattaacatttactgctataggagcaccggctacttttaaattctttgataaaaatattgatcgaaaacgatatacttcaactactgaaattctcaacgctaccctcatccaccaatccatcaccggtctttatgaaacgcggattgatctcaataagttaggaggagactaa

SEQ ID NO: 379 - DNA, 3390 bp, Streptococcus orisratti DSM 15617
atgacaaatggaaaaattttaggtttggatatcgggattgcatctgtaggagttggtgttattgaagctgatacaggaaaagttgtccatgcaagttctcgattatttccatcagctaatgcggataacaatgcagagcgtcgaggttttcgtggtggaaggcgcttgattcgtcgtaagaagcaccgtatgaaacgtgtgaaagatttatttgaagaatataaactagagacacgatttaacaatctaaatttaaacccatatgagctaagggttagaggactgacagagaagctggcacctgaggaactgtttgctgcattgaaaaatctcagtaagcatcgggggatatcttatcttgatgatgcagaagatgataatgcaagtgctaaaactaactatgctaaatctgttttagctaataaagagcttctaaaaacaagaacaccaggacaaattcaatgggaacgctttgaaaaatatggtcagatacgtggagattttgacattgtgacacctgagggagagcaacagcggattatcaatgtcttttcaacgacagattataaaaaagaagcagagcaaatcttggagacacaagcactctattatcctcaaattagttcagaatttattgaggattttattactattttaacctcaaaaagaaaatattatcatggcccaggaaatgaaaaatctcggacggactatggacgctatcgcacggatggtacaacgcttgataatatttttgatattttagttggaaaatgtggtatctatccagatgagtaccgtgcagcaaaggcttcctatactgcacaagaattcaattttttaaatgatttgaataatttgacacttcctacagagaccaagcgtttaagcactgatcagaaaaaagacctagtcagatttgcaactactgctgcaactttaggacctgacaaattactaaaagaaattgctaggatggttggatgctccaaagatgatatcaaaggctatcgtattgacaataaagaaaaaccagatttgcatacttttgaagcttatcgagcgatgaccaaattaaatacctttgatgtagctaccttctctagagaaatgatagatgagctagcacgtattttaactctaaatacagacagagaaggaattgaagaggctatcgtaaacgattttcccaatctattttctagggaacaaattgatgaattgattcagtttagaaaatcaaaaagccagctatttggaaaaggttggcatagcttctcactgaaattaatgtcagaacttattcctgagttatatgctactagtgaagaacagatgaccattttgacgagattaaataaaatgtctcccgagcgaaaagtcactcttcgaaccaagtacatcaatgagcaggatgctacagaggagatttataatcctgttgttgctaaatctgttcgacaagctattaaaatcatcaatgaatgtatcaaaaagtggggagaatttgatcagatcgttattgaaatgccacgtgataaaaatgaagatgatgagaagaagcgaattgcggatgggcaaaaagctaatgctaaggaaaaggcgagtgccacagagtttgcagcatctctttacaatgggaaaaaagaactgccagatgaggtctttcatgggcacaagcagttagctactaagattcgtttatggtatcagcaagacggaaaatgtttatacactggtcaagatatctctattcatgatttaattcataatcaaaatcaatatgaaattgatcatattatgcctttatccttatcgtttgatgatagtctgagcaataaggttttagttttagcaaccgcaaaccaagaaaaagggcagcaaacgccttatcaggctattccaaagatgaagtcagcctggtcttatagggaatttaaagcctttgttttggattgtaagaggttaagtaagaagaaacgtgagtatttattaacagaagaagatattgataaaattgaggtcagacgaaaatttattgcacgtaacttggttgatacacgctatgcttcgcgggtagtgctaactaccttacaagatgctttagaagtaatgaataaagagaccaaagtttcagtagttcgtggtcaatttacctcacaattgcgcagacagtggaaaattgataaaacacgagatacctatcatcatcatgctattgatgctcttattattgcggcttctagtcagttaaaattgtggaaaaaacaagataatccgatgtttgaagagtatgagcaaggtcaaaagatcaatttggaaacaggtgagattttatcagatgacgactacaagaaattagtcttccaatcaccttatcaaggctttgttcacacgatttcttcaaaatcatttgaggatgagattctcttttcttatcagatagattctaaggtcaaccgaaaaatctcggatgcaacgatttatgcgacaagacaagcgcaattatcaagagataggaaaaaagaaacctatgttttaggtaaaattaaagatatctatagccagacgggttatgatgccttccgtaaacgatatgataaagataagacagtatttttaatgtatcagaaggatcctttgacttgggaaaaggttattgaagtgattctacgtgattacaaagagtttgacgataaggggaaagaagtcggcaatccttttgaaagatatcggcaacaaaatggcttaatgactaagtatagtcgtaaaaacaaaggaaccccgattaaggcattgaaatattatgataataaacttggaaaccatgttgatgtcacaccagatgacagtaagaatcctgtggttttacaatctataaacccttggagagcagacttatactttaatcctaaaactgctaaatacgaattattaggactgaagtacgctgacttaagttttgaaaaaggaacaggaaattataccatctctcaagaaaaatacgatgaaatcaagaaaagagaaggtatttctgcagaatcagaatttaagtttactctttataaaaacgacctattattaataaaagatattgaaaatggcgaggaacaagtatttagatttttgtcacgtaccatgccaaatcaaaaacattatgttgagttaaaaccctatgataaggctaaatttgatggtgggcaatctttacttactgttttaggaacagttgccaaaggaggtcagtgtctaaaaagtttgaacaaagttggtatttccatctacaaagttaaaaccgatgttcttggttatcagcactttatcaaaaaagaaggaaatcagcctaaactgagctttgaaaatagtattaaacgacataaaaataaatga

SEQ ID NO: 380 - DNA, 3423 bp, Streptococcus parasanguinis F0449
atgaatggtttagttttgggtttggatattggtattgcttcggttggagtaggtattctaaaaaaagatattggtgaaattattcacactaattctcgtctgttttcagctgcaacggctgacagtaatattgaaagaagaggacataggggaggtaaaagattaactcgccggaagaaacatcgtagtattcgccttcatgatttatttgaagactttggtttgttaactgatttttctaaggtgtccattaatctaaatccttatcaactccgtgtacaagggttggataatcaattaactaatgaagagttgtttattgctttaaagaatattgtgaagagacgtggtattagctatttggatgatgcttctgaggatggcggtacagtatcgtctgattacggtaaggcagttgaagaaaatagaaaattacttgctgaacaaactcccggacaaattcaactagatcgtttcgaaaaatatggtcaggttagaggagatttcaatgttgtagaaaatggtgaaaagcgcagattaatcaatgtttttacaacatctgcttatagcaaagaagctgaaagaattcttagaaagcaacaagaattcaataaaaagattacagatgagtttatagaggattatctaacaatccttacgggaaagagaaaatactaccatggaccaggtaatgaaaagtcacgcaccgattatggaaggtatactactaagaaagatcctgaaggtaagtacataaccttagataatatttttggtattttaattggtaaatgtacattttatcctgatgaatatagagcttcaaaagcttcctatactgctcaagagttcaacttactaaatgatttaaataatttaactgttccaacagaaaccaagaaactgagtgaggaacaaaagaagacaattatcaagtatgcgaagacagctaaaacattaggagcttcaacactattgaagtacatcgctaaattaattggtgcctcagttgatcagatacatggataccgtattgatcccaataaaaaacctgagatgcatacttttgaaacctatcggaaaatgcaatcattagaaacaatcagcgtggaagaattaccgagaaaggtcttagatgagcttgcccatattctaactttaaatacagagcgagagggaatagaagaagcaattaacgcgacgctaaaagatacatttagtcaggatcaagtacttgaattggttcaatttagaaaaaataatagcagtctatttagtaagggatggcatagtttttctctaaaactcatgatggagttgattccagaattgtatgagacttcggaagagcaaatgacaattcttactcgattaggcaaacaaaaatctaaagagacatcaaaacgaaccaagtatattgatgaaaaagaattaacagaagaaatctataaccctgtggtagcaaaatctgtcagacaagctataaagattatcaatgaagcaactaaaaaatatggtatctttgataatatcgttattgaaatggcacgtgaaaataatgaggaagatgcaaagaaagagtatatcaagcgtcaaaaagcaaatctagacgagaaaaatgcagctatggaaaaagcggctttccaatacaatgggaaaaaagaattaccggataatgtttttcatgggcataaggaattagctactaagattcgtttatggcatcagcaaggagaaaagtgtctttacactggtaagaatataccaatttcagatttgattcaaaatcagtataagtatgaaattgatcatattttacccttgtctctttcttttgatgatagtttatccaataaagtattggtacttgctacagcgaaccaagaaaagggacaacgtacaccgtttcaagctttagatagcatggatgatgcctggtcttaccgtgagtttaaatcatatgtaaaagattctaaattattaggtaataaaaagaaggaatatcttttaacggaagaagacattagtaagattgaggtgaaacagaaatttattgaacgaaatttagtagatactcgttattcttctcgcgttgttctaaatgctctacaagatttttataaggagcatcaattcgatacaactatttcagtggtacgtggacaatttacttcgcaactcagaagaaagtggggacttgaaaaatctcgtgagacctatcaccatcatgctgtagatgctttgatcattgctgcatctagtcaattaagattatggaaaaaacaaaataatcctttgatctcttatacagaaggtcaattcgtggatcaagtaactggtgaaattatttcattgagtgacgatgaatataaagagttagtatttaaagcaccatatgatcattttgttgatacattgaagtccaagaaatttgaggatagcattctattttcttatcaagtagattcaaaatataaccgaaagatttcagatgcaacaatttacgcaacaagaaaagcaaaattagataaagagaacaaagaatacacttatactttaggaaaaataaaagatatctatgctttagggacaaaaagtccttctaaaacgggattttataaatttttagatttatacaataaggataaatcccaattcttgatgtttcagaaggatagaaaaacttgggatgaagtgatagagaagataatagaacaatatcgaccatttaaagaatacgatgaaaatggaaaagaagttgatttcaatccttttgaaaaatatagaattgaaaatggtcctattcgcaaatatagtaaaaaaggcaatggtccagaaattaaaagtctaaaatactacgataatcttttagggaaatttgttgatataactccttcagaaagtaagaatcctgtagctttgctttctttgaatccttggagaacagatgtatactacaatacagaaacaagcaaatatgaattcttaggattaaagtatgcagatttgtgtttcgaaaaaggtggtgcttacggaatttcagaagttaaatataataaaataagagagaaagaaggaattggtaaggaatctgaatttaagtttacactatataagaatgatctaattttaattaaggatactgaaacaaattgccaacaaatctttagattttggtctcggacagggaaggataatccaaaaagctttgaaaagcataaaatagaattaaaaccttatgaaaaagcaagatttgagaaaggagaggaacttgaggtattaggaaaggtaccaccttcttctaatcaattacaaaaaaatatgcaaatagagaatctttctatttataaagttaaaacagatgttttgggtaataaacatttcatcaaaaaagagggtgaagaaccaaaactcaaattttaa

SEQ ID NO: 381 - DNA, 4158 bp, Streptococcus salivarius K12
atgactaagccatactcaattggacttgatattgggacgaatagtgttggatgggctgtaataactgatgattacaaggttccatctaaaaaaatgaaagtcttaggaaatacgagtaaaaagtatatcaaaaagaacctgttaggtgcattactctttgactctggaatcacggcagagggaagaagattgaagcgtactgcaagaagacgttatactagacgtcgtaatcgtatcctttatttgcaggaaatttttagcacagagatggctacattagatgatgctttctttcaaagacttgacgattcatttttagtccctgatgataaacgtgatagtaagtatccgatatttggaaacttagtagaagaaaaagtctatcatgatgaatttccaactatctatcatttaaggaaacatttagcagatagctctaaaaaagcagatttgcgtctagtttatcttgcattggctcatatgattaaatatagaggtcacttcttaattgaaggagactttaattcaaaaaataatgatcttcagaagaactttcaagactttttggacacttataatgcaatttttgaatcggatttatcacttgagaatagtaaacaacttgaggaaattgttaaagataagattagtaaatcagcaaagaaagatcgtattttaaaactctttcctggggagaagaattcgggtattttttcagagtttctaaagttgattgtaggaaatcaagctgactttaggaaatattttaatttagacgaaaaaacttccttacagttttctaaagaaagctatgacgaagatttagagactttgttaggtcacattggagatgattacagtgatgtctttctcaaagccaaaaaactttatgacgctattcttttatcaggtattctgactgtaactgataatggtacagaagcacctctttcttctgctatgataatgcgatataaggaacacgaagaggatttggccttactaaaggcatacataagaaacatttcgctagaaacgtataatgaagtatttaaagacaatactaaaaatggttatgctggttatattgatggaaaaacaagtcaggaagatttctatgtatatctaaaaagactattggctggtcttgaaggtgcggactattttcttgaaaaaattgatcgagaagactttttaagaaagcaacgtacatttgataatggttcgataccatatcagatttatcttcaagaaatgagagcaattcttgataagcaagctaaattttatcctttcttggctaagaataaagaaagaattgagaagattttaaccttccgaattccttattatgtaggtccacttgcgagagggaatagtgacttcgcttggtcaataagaaaacgaaatgaaaaaattacaccttggaattttgaggacgttattgacaaagaatcttcggcagaggctttcattaatcgaatgactagttttgatttgtatttgccagaagagaaggtacttccaaagcatagtcttttatacgaaaattttacagtatataatgaattaacaaaagttagatttatcgccgaaggtatgagagattatcaatttttagatagtaagcagaagaaagatattgttcgactttattttaaaggtaaaaggaaagttactgataaggatattattgaatatttacatgcaattgatggatatgatggaattgaattaaaaggcatagagaaacagtttaattctagtttatctacttatcacgatcttttaaatattattaatgataaagagtttttggatgatagttcaaatgaaacgattatcgaagaaattatccatactttgacaatgtttgaagatagagagatgataaaacaacgtctttcaaaatttgataatatttttgataaatccgttttgaaaaagttatctcgtagacattatactggctggggtaagttatctgctaaactaattaatggtattcgtgatgaaaaatctggtaatactattcttgattacttaattgatgatggtgtttctaaccgtaatttcatgcaacttattcacgatgatgctctttcttttaaaaagaagataaagaaagcacaaattattggtgacaaagataatattaaacaggtcgttaagtctttgccaggtagtcctgcgattaaaaaaggtattttacaaagtataaaaattgtagatgaattggttaaagtaatgggaagggaacctgagtcaattgttgttgagatggctcgtgaaaatcaatataccaatcaaggtaagtctaattcccaacaacgcttgaaacgtttagaagaatctctcaaaggcttaggtagtaagatacttaaggaaaatgttcctacaagactttctaaaatagacaataacgcacttcaaaatgatcgactttatttgtattatcttcaaaacggaaaagatatgtataccggagaagaattagatattgatagattaagtaattatgatattgatcatattattcctcaagcttttttgaaagatgattctattgacaataaagtacttgtttcatctgctagcaaccgtggtaaatcagatgatgttccaagtttagaggttgttaaaaaaagaaagacactttggtatcaattattgaaatcaaaattaatttctcaacgaaaatttgataatctgacaaaagctgagcgaggaggtttgtcacaagaggagaaagctgggtttattcaacgccagttggttgaaacacgtcaaataacaaaacatgtagctcgtttacttgatgagagatttaataataaaaaagatgaaaataatagaacgttacgaacagtaaaaattattacattgaaatctagcttggtttctcagtttcgtaaggattttgaactttataaagttcgtgaaatcaacgattttcatcatgctcatgatgcctacttgaatgctgttgtagcaagtgctttacttaagaaataccctaaactagagccagaatttgtgtacggtgactatccaaaatacaatagttttagagaaagaaagtcagctacagaaaaggtatatttctattcaaatatcatgaatatctttaaaaaatctattcctttagctgatggcacagttattgacagaccacttattgaggtaaatgaagagacaggtgaatccgtttggaataaagtggcagacctaaatactgttagaaaagtcctttcatattcacaggttaatattgtcaaaaaagttgaggaacaaaatcacggattggatagaggaaaaccaaagggattgtttaatgcaaatctttcctcgaaaccaaaaccaaatagtaaagaaaatttagtaggtgctaaagagtaccttgaccccaaaaagtacggagggtatgctggaatttctaattcatttgctattcttgttaaaggtacaattgaaaaaggtgctaagaaaaaaataacaaatgtactagaatttcaaggaatttctattttagataggatttattatagaaaagataaacttaattttttacttgaaaaaggttataaagatattgagttaattattgaattacctaaatatagtttatttgaactttcagatggttcacgtcggatgttggctagtattttgtcaacgaataataagaggggagagattcacaaagggaatcagatttttatttcacagaagtttgtgaaattactttatcatgctaaaagaataagtagcacatttaatgagaatcatagaaaatatgttgaaaatcataaaaaagagtttgaagaattattttactatattcttgagtttaatgagaattatgttggagctaaaaagaatggtgaactcttaaaatctgcctttcaatcatggcaaaatcatagtatagatgaactctgtagtagttttataggacctaccggaagtgaaagaaagggactatttgaattaacctctcgcggaggtgctgctgattttgaatttttaggtgttaaaattccaaggtatagagactataccccatcatccctattaaaagatgccacacttattcaccaatctgttacaggcctctatgaaacacgaatagaccttggcaaactaggagaggattaa

SEQ ID NO: 382 - DNA, 4179 bp, Streptococcus sanguinis SK330
atggaaaacaaaaattactctatcggactcgatatcggaactaacagcgtcggatgggccgtcattacggatgactataaggtgccatcgaaaaagatgaaagtttttggcaatactgataaacactttatcaagaaaaatctaattggagctttattatttgatgaaggggctactgctgaagatagacgtctaaaacgaacagcgcgccgtcgctatacccgtcgaaaaaatcgtcttcgctatcttcaagaaatcttttctgaggaaataagcaagttggatagtagtttctttcatcgattagatgactcttttttagttcctaaggataagagaggaagtaaataccctatttttgctaccttggaagaagaaaaagaatatcataagaaattcccgactatctatcatttgagaaaacacctggcggactcaaaagaaaaaactgacttgcgcttaatctatttggcattagctcatatgattaaataccgcggacattttttatatgaagaatctttcgatattaaaaacaatgatatccaaaaaatttttaatgaatttataagcatttacgataacacctttgaaggaagttcacttagtggacaaaacgcacaagtagaagcaatttttactgataaaattagtaaatctgcaaagagagaacgcgttctaaaactcttttctgatgaaaaatccactagtctcttttcagaatttctcaagttaattgtaggaaatcaggctgattttaaaaaacattttgacttagaagaaaaagctccactacaattctctaaagatacctatgatgaggatttggaaaacttactcggacaaattggagatggttttacagaccttttcctagttgctaaaaaactctatgatgctattcttctatcaggaattttgactgtcacagatccttcaaccaaggccccactatcagcatctatgattgagcgctatgaaagccaccaaaaagacttggcagctttaaaacaattcatcaaaaacaatcttccaaaaagatataatgaagttttttctgaccaatctaaagacgggtatgctggatatatcgatggcaagaccactcaagaagcattttacaaatatatcaaaaatcttctctctaaattcgaaggagcagattatttccttgataaaattgaacgtgaagattttttgagaaaacagcgcacctttgataatggttctattcctcatcaaattcatcttcaagaaatgaatgccattctccgtcgacaaggagaacattatccatttctgaaggaaaacagagaaaagattgagaaaatcttgaccttccgtattccttactatgttggtccattggctcgtggcaatcgtgattttgcttggcttactcgaaattctgaccaagcaatccgaccttggaattttgaagaaattgttgataaagcaagctctgcagaagaattcatcaataagatgaccaactatgatttgtatttaccagaggaaaaagttctgcctaagcacagtctgttgtatgaaacatttgctgtctataatgaattaacaaaagtaaaatttattgcagaaggattgagagattatcaatttcttgatagtgggcagaagaagcaaattgtcaatcaattattcaaagaaaaaagaaaagtaactgaaaaagacatcatccattatctacataatgttgatggctacgatggaatcgaactaaaagggattgaaaaacaatttaacgcaagtctttctacttatcatgatttgctcaagattatcaaggataaagagtttatggatgaccctaaaaatgaagagattcttgaaaatatagtccatactctcacaatatttgaagatcgtgagatgattaagcaacgccttgctcaatatgactccatctttgatgaaaaagtgattaaagcactgactcgtcgacattatactggttggggaaaactctctgccaagctgattaacggtatctgtgataaacagacaggagatacgattcttgactacttgattgatgacggtaagatcaatcgcaactttatgcagttaatcaatgatgacgggctttctttcaaagaaattatccaaaaagcacaagtagttggtaaaacagatgatgtgaagcaagttgtccaagaacttccaggcagtcctgctattaaaaaaggaattttacaaagtatcaagattgttgatgagcttgtcaaggttatgggctatgctcctgaatcgattgtaattgaaatggctcgcgaaaatcagacaactgccagagggaaaaagaattcacaacaaagatataaacgtattgaagactcactgaaaaatctagcacctggacttgattcaaacatattaaaagaaaatcctacagataatattcaacttcaaaatgatcgcctcttcctctactatctccaaaatgggaaggatatgtacacaggaaaacctcttgatattgaccaattgagtagctatgacattgatcatatcatccctcaggctttcattaaggatgattcgatcgataaccgtgtcttgactagttcaaaggataatcgtggtaaatccgataatgttccaagtttagaggttgttcaaaaaagaaaagctttttggcaacaattgttggattccaaattgatttcagaacgtaaatttaataatttaaccaaagctgaacgaggtggactagatgagcgtgataaagttggctttatcagacgccaactagttgaaacacggcaaataacaaaacatgttgcacagattttggatgccagtttcaatacagaagtgaatgagaagaaccagaaaattcgtaccgtcaaaatcatcactttgaaatccaatctagtttccaacttccgtaaagagtttgagttatacaaggtacgggaaatcaatgactaccaccacgcgcatgatgcctatttaaatgcagtagttgctaaggctatccttaagaaatatcctaaactagaacctgaattcgtctatggtgactatcaaaagtacgatcttaagagatacatctcaagattcaaaccctctaaagaaattgaaaaagcaactgagaagtatttcttttactcaaacttgttgaatttcttcaaagaagaggtgcattacgcagacggaataatcgtaaaaagagagaatatcgaatactccaaggacactggagaaatcgcttggaataaggaaaaagatttcgcaacaatcaaaaaagtactttcctatccacaggtgaatattgttaagaaaacagaaattcagacacatggtctagatagaggtaaacctaaaggcttgttcaattctaatccatctcctaaaccgtcagaagatagtaaagaaaatcttgttccaattaaacaagggcttgatccacggaaatacggtggttacgctggtatttctaactcgtacgcggtcttagttaaagctattgttgaaaaaggagcgaaaaaacaacaaaagacaattcttgagtttcaaggtatctctattttagataaaataaactttgaaaataacaaagaaaactatcttcttaaaaaaagatacatagagattctatcaactattactttacctaaatatagtttgtttgagtttcctgatggtacaagaagaagactggcaagtattctatcgacaaacaataaacgaggagaaattcataaaggaaatgaattagtacttcctggcaaatatactacacttttgtatcatgctaagaatattaataaaaaacttgaaccagagcacttagagtatgttgagaaacatcgaaatgattttgctaaacttttagagtgtgtacttaattttaacgataagtatgtaggcgcattaaaaaatggagaaagaatcagacaagcatttactgattgggaaacagttgatatcgaaaagttgtgtttcagtttcattggtccagaaaatagtaaaaatgccggattattcgagttgacctcacaaggaagtgcctctgattttgagtttttaggagtaaaaattccacgatacagagactatgcaccgtcatcgcttctcaaggccaccctcatccaccaatccatcactggtctttacgaaactcggattgacttgagcaaactaggagaagactaa

SEQ ID NO: 383 - DNA, 3387 bp, Streptococcus vestibularis ATCC 49124
atgagcgacttagttttaggacttgatatcggtataggttctgttggtgtaggtatccttaataaagtgacgggagaaattatccataagaattcacgcattttcccagcagcccaagcggaaaataatgtagaacgtagaacaaatcgtcaaggaagacgattgacacgacgtaaaaaacatcgtagagttcgtttaaatcatctatttgaggaaagtggattaatcaccgattttacgaaggtttcaatcaatcttaacccatatcaattacgggttaagggcttgatcgatgaattgtctaatgaagaattgtttatcgctcttaaaaatatggtgaaacaccgtgggattagttatctcgatgatgccagtgatgacggaaattcatcagtaggagactatgcacaaattgttaaggaaaatagtaaacaattagaaactaagacaccgggacagattcagttggaacgctaccaaaaatatggtcaattacgtggtgattttactgttgaggaagatggaaaaaaacatcgcttaattaatgtctttcctacatcagcttatcgttcagaagccttaaggatactgcaaacccaaaaagaatttaatccacagattacagatgaatttattaatcgttatctcgaaattttaactggaaaacggaaatattatcacggaccaggtaatgaaaagtctcggactgattatggaaggtatactactaagaaagattctgaaaatgagtacataactttagacaatatttttggtatcctaatcgggaaatgtacattttatccagaagagtatagagcagcaaaagcatcctacacggctcaagaattcaatttgctaaatgatttgaacaatctaacagttcctactgaaaccaagaagttgagcgaagaacagaagaatcaaatcattaattatgtcaaaaatgaaaaggcaatggggccagcgaaactctttaaatatatcgctaaactactttcttgcgatgttgcggatatcaagggataccgtatcgacaaatcagataaggctgagattcatactttcgaagcctatcgaaagatgaagacgcttgaaaccattgattttgagaaaatgtcaagagaccaacttgataagttagcctatgtcttgacattaaacactgagagggaaggtattcaagaagccttagatcatgagtttgctgatggtaactttagccaggagcaaattgacgaattggttcaattccgcaaagcaaatagttccatttttggcaaaggatggcataatttttctgtcaaactgatgatggagttaatcccagaattgtatgcgacgtcagaagagcaaatgactatcctgacacgacttgggaaacaaaaaacaacttcgtcttcaaataaaacaaaatatatagatgaaaaactattaactgaagaaatctataatcctgttgttgctaagtctgttcgccaagctataaaaatagtaaatgcagcaatcaaagagtatggagactttgacaatattgtcatcgaaatggctcgtgaaacaaatgaagatgatgaaaagaaagctattcaaaagattcaaaaagcaaacaaagatgaaaaagatgcagcaatgcttaaggctgccaaccaatataatggaagggctgaattaccacatagcgttttccacggtcataagcaattagcgactaaaattcgcctttggcatcagcaaggagaacgttgcctttatactggtaaaacaatttcgatccatgatttgataaataatcctaatcaatttgaaatagatcatattttacctctttctatcaccttcgatgacagtcttgctaataaggttttggtttatgcaactgctaaccaagaaaaaggacaacgaacaccttatcaggctttagatagcatggatgatgcatggtctttccgtgaattaaaagcttttgtacgtgagtcaaaatcactttcaaacaagaaaaaagaataccttcttacagaagaggacatttcaagatttgatgttcgcaagaaatttatcgaacgaaatcttgtagatacaagatacgcttcaagagttgtcctcaatgcccttcaagaacactttagagctcacaagactgatacaaaagtttccgtggttcgtggtcaattcacatctcaattgagacgccattggggaattgagaagactcgtgatacttatcatcaccatgccgtagatgcactgattattgctgcttcaagtcagttgaatttgtggaaaaaacaaaagaatacccttgtaaattattcagaaaaccaactacttgatattgaaactggtgaacttattagtgatgatgagtacaaggaatctgtgttcaaagccccttaccaacattttgttgatacattgaagagtaaagaatttgaagacagtatcttattctcatatcaagtggattctaagtttaatcgtaaaatatcagatgccaccatttatgcaacaagacaggctaaagtaggaaaagataagaaggatgaaacttatgtcttagggaaaatcaaagatatctatagccagactggctatgatgcctttataaagatttatcagaaggataagtcaaaattcctcatgtatcgtcacgacccacaaacctttgagaaagttatcgagccaattttagagaactatcctaataaggaaatgaatgaaaaagggaaagaagtaccatgtaatcctttcctaaaatataaagaagaacatggcgactatattcgtaaatatagtaaaaaaggcaatggtcctgaaatcaagagtcttaaatactatgatagtaagttaggtaatcatattgatatcactcccaaagatagtaacaataaagttgtcttgcagtcagtttctccatggagagcggatgtctatttcaataagactactggaaaatacgaaatccttggattaaaatatgctgatctacaatttgagaaagggacaggaacatataagatttctcaggaaaaatacaatgtcattaagaagaaagagggtgtagattctgattcagaattcaagtttacactttataaaaacgatttgttgcttatcaaagatacggaaacaaaagaacagcagctattccgtttcttatctcgtactaaacctaatgttaaacactatgtagaattaaaaccttatgataaacagaaatttgaaggaaatgaatcgttaataaatgtactaggagctgtagctaaaggtggtcaatgtcaaaagggaataaacaaacccaatatttctatttacaaagtaagaacggatgttctaggaaatcagcatatcatcaaaaatgagggtgataagcctaagctagatttttaa

SEQ ID NO: 384 - DNA, 4101 bp, Lactobacillus composti DSM 18527
atgacaaaagactatagtttaggcttagatattgggacaggcagtgtgggtttcgctgccttagacaccaattatcgcttgttgcgggctaagggcaataatgttattggggtgcgcttgtttacgccagcggagactgctgaagaacggcggggctttcggacagcacggcgacgtttaagtcggcggcgctggcgcctgggggcattgaacgggatattcgccccagaattagctaaggtggatcctaactttttgcatcggttaaagtacgcttgggtgcatccagcagatcaacaaaacaaaggtaaatattccgccgcgcctttgtttaacgatgctgcgctggaccgccaatttcatgatgactatcccaccatttatcatttgcggctaaagttaatgacggatacttcacaacatgatttaagagaagtttatttggctattcatcatattatcaagttccgggggaactttctcagaggggaagggccaattaatgccagcgaagcctttgacattaatacttttattgaccaaatgaccgctttttatgatcaagccttcccagatttcaagattgtggatcaagtggaccaacaaataatctttaaagggttaacggacatgacgttgtcccctgcagatcgggccaataaggcccttatggggtttaataacgctgcccagcaacctaataagagaatatttaaggctattttaagcggccttgtggggaatcaagtggacttaatggctatttttcagttagatgggattcccaaagaagaccaaaaagaatttaaattcaaatttgttgacaacgatatcgaagagaagctggcggctctcggggataatccggctttatctgatgaacaaaacgaatttttgacaacgctttatgccgccttcagtggcttgactttaaagggcttattgggggatgctacctcgatttcagctgctatggtggctcgctacgctagccatcgcaccgactggacctatatcaaagaccacgttttaacaccgcagaataatcgggaattgcgtctggcttatgccgacttgatgactgacaacgaagacgtgcgattgaaagcgggcaagaagttcgctaaagccattgaggcagctgatatcccagcggctaaaaagtcggaattttcactgaaaatcgacaataatgaattcttaccccgccaaagaaccaaagcaaatggtacgattccccaccaactccatttaaacgagttgcagcaaattattgaaaatcaggggcaatattatcccttcttaaaagccacttttgagcaggatggccatactttgaataaaattgaaggtttggtgaagtttcgcgtcccttattacgtggggcccttggtgcccaagcacaaggtggcggggaataacgctaatcattggatggttcctaaagaacctggcgccatcactccttggaactacacggaaaaagttgatcgggacaaatctgggaatgaatttattcggcgcatgactggtaccgatacttatctgttaggagaacccaccttacctaagaattctctggtctaccaagaatttaatgtgttacaagaattgaataatcttcgcatcgaaaagcgccgcttagatattgctgtgaagcaagatatttttgaacatgtttttaaaaccaataaaacagttacagtcaaacgcattgaagaatatttgaccacagaatttggcagccccgtaacattgagtggctttgctaatgtgaacgaacgcaaattaaacagctcgctgagcacctaccattattttgtggggatatttggcgctgagtttgtagatgaccctaaaaacttaacactcttggaacaaattgtggaattacaaacggtttttgaggaccgtaaagcgttacaacgtcaattgaaattgcgaccagagttgtcagaaaagcaggtcaaacaactggcccggacgcattacactggttggggtcgactatcccaaaaattattgaccagtaaaatcgttcacgtggctttagagggtgagcgggaaccagggcaatattcaattttagaaacattatatggcacacaaatgaactttatggaaattgtgaatgatatgaaggaccgatatggggtcaagtcttggttggaccaggaaaatagcggttccgaaaataatctgagtttgaaacaacggattttagatatgcctgggccgaagaatattaaacggggtatcaatcaagcctttcatattatcgatgaaatcacccgggccgtggggaacgcccccagccggatttatatcgagtttgcccgggaaagccaacagtctaatttaaccaatgcccgggtcaaccgactgaaacaactttatagcaatcaggctctgaaaaaagaatttgccaagctggctagtgaaataaaagacctcaccaaagaacaattaaaggacgatcggttgtatctatattatctgcagcaaggcaaagatatgtacactgagactgatatcgatataactaaaatttccagtaactatcaaattgatcacattattccgcaagcctatacgaaaaataatagtttggataatcgggtactggtcaattcagagatgaacgcccgtaaatcagattcaccgacatttttgcccagccttattcaagagcgcaaagcttggtggcggcagttaagggacaccgggttgatgagtaccattaagtataataatctaacccggacatccgatgatttttccgctgaccagaaagaacgtttcattgctcggtctttggtagaaactcgacaagtgatcaaaaacgttgcaacgttgattaaagagtattacgacgattctcaagttgaagctctaccttctgaaatcactgctgaaatgcggcgctatttgaatgttcgtaagaatcgagatatcaatgattatcaccatgcccatgatgccttattattcgccacagccggtgaatttagccgtaaggtgggtattatggagaaggggcgtgttagcgacggggctgggaatatctacaatcgatataccaaagatattatccaacgggcccgggcaaaagccggtcaggataagaaagttcgaccgtttacttttattgtggggtcaatggctaatcctgacacgaagtttcaaaccaatcaaaccaccggtgaaattgtctggacgccggaggatgtggcttatttacggaaagtcatcgattataaaaagatgctggtgactaaaatgaccttggaccaaaccgggacactctataatgagacccgctatggtagtggggataagcacgtggcagttgcgttaagtaaagataaagcagctgacttatatggtggttttggttctctgaagccagcttacgctgctttggtatattccaagaagaaattccgcctagtaaatgtactgcgtctctggttaccggaaattaaaaagaatgccagtgttcttgaaagaaaggtgcaatctgtgcttggagatgacaacgcgaaagtcattcgcgcccacgtaccttgtggacaattattgattaaagatggtgcattagttacggtctcctcagctactgagttgcataatttccgacaactatggctaccaaaggcagattatcaagatatttcgattctgcttggggcgccggataaagtaacagctgagaatcgactgcaggctgaatcgcactttgatgatgtggatcagcggtttgaaagtttgttgaaggatgttattgatcaagcacggcaatactatccgttgaagactcatcaaactagcttagaaaaactgattggtaaaatcggtaaatttgatgagttgaaatttgctcaaaaacaacaagtatttagtaggttattaagcgcgttacatgccaatgcaactaatagtgacttgaaacagattggtttgtcaactgcctggggccggcttatttatcctaaaggtgtttcactgactgatgaagataaattaattaacagttcatttactggattgtttaatgacgttatgagtatcaaagaatttcacgatttttcaatcaactaa

SEQ ID NO: 385 - DNA, 4101 bp, Lactobacillus concavus DSM 17758
atggataaaaaatataatattggactagatatcggaacaagttccattggattcgtggcgaccgatgaagacaaccatgtgattcgtgcgaaaggcaagaatgtgattggcgttcgcttatttgatgaaggtcaatctgctgcggaacgacgcggctttagaacaactcgacgccgcttgaaccgacgcaaatggcgcttgaatttgttgcgcgaaatattcgagccacacatttatcccattgacgcttcttttttcatgcggcaaaagtactcaaacttatctaaacaagatcctaatcagaagattgagtttaaggatattttattctcggataagtcggatgccgagttttatcgccaatacccgaccatttatcatctgcgtcaggctttgatgactgagaaacgacaatttgatttgcgtgagatttatttggcgattcatcatattgttaaatatcgtgggcatttcttggatgaaacgccgacagataaattctcgttcgatcaattagatctgactcaagagtttgaacgcctgaatgtgttgttttcggaacaaaatccggaagaaccatttgaaattgtcgtcaatcaaaatcaatcgattgaggacatcctttctaatcaaagtatgactgcgagtgatcgacgcaagcaagcgctggttgttttctatcaacaatcagagaacaaagagaacgagaagcagtacaaagcaatcgccacagaaattctaaacctcttgttgggtaacaaagccaagttaaatgttatcttggcacaagaggtcgataaagaagcagccaaggattggtcattgtcgttgtcttccgagacgtttgatgatgatcttgaaaaggcttcgagtggtctaaacgacagtcaactggaaatggtcggcatctttgagcgcatttattcatcgctaattttgaagtcgatcataggggatcacaacagtttatctgctgccatggtcgataaatttaagacccatgcacagcatcgcgatttattaaaggatgtcatcaaaaacagcgatgcaactaaaggcgagcaattgcagtttgcctacgatcactatttacaacgtcattctgcagatggtaaagcttacggaaaagatgatttttacaaggaggttaagaaaaatcttgatgactccgatgcggcgcaacaaattcagcaattaattgacaccgaccagttcatgccaaagcagcgtaccaaggcaaacggtgcgattcctcaccaagtgcagcagaaagagctggacttgattatcgagaatcagtgccaatactatccttggctagcagaggagaaccccaactcagaacgtcataacgttgccaagtacaaactggacgaattggtctcgtttagagtgccctactacgttggacctctaatttcgccggctgacgatgagacagatccacaagcaattcagaatactaagtttgcgtggatgattcgcaaagatgctcagggtcgaattacgccttggaatttcgatgataaggtcgatcgcgaaaagagtgccgacaagttcattaaaagaatgacaactacagatacttacttgattggcgaagacgtgttgccagatcaaagtttgatttaccaacgctataaagttctgaatgaactaaataacgttcgtattaatggccggccaatagaagttcagatcaagcaaaacatttacacggatttgtttaagaagtttaagtcagtctcggttaaaaagctacgcagttatttggaagaaatgagctattaccctggttcttttaaaattagtggtctcacgaatccgggtaaatttgataatgggttgacatcatatcttgattataaaaatattttaggcgatagcgtcgatgccaatgataaacgtgctgacattgagcaaatgattgaatggtcaacgatttttgaagacaacaagatttttgcacaaaaattggaaagtatgacttggttaaccgcagaacagcgtaaagcaatttcccgcaagcgatacactggttgggggagattatcgaacaaattattgacccagctgaagaatcaggataatcgctcgatcatggacttactctgggaaacagaagagaacttcatgaagattcagtccgccccagatttttcaaagatgattgaagcacataaccagcaattcattaaaaatgaagctaacattcaacaagtcatctcagatttatatacttcgccacagaataaaaaagccattcgccagattttattagtcgttgacgatattcaaaaagcggtgggacacgcgcccgagcatattgcaatcgagtttgcaaagggtgaggataagaatcctagacgtacgatcagtcgtgaaatgaaaatccaagatgtttatcaacaaatctccgatgatattctcgtctcgccagaggtcagagcgcaacttaatgagaaaattgaaaatcgtcatgggcgtctgagtgatcgacttttcctgtatttcatgcagggtgggcgagatatgtatactggcaagccaatcaatattaataatatttcacattatgatattgaccacatcttgcctcaggcatttatcaaggacgactcgctggataatcgtgtacttgtcagtgacaagcttaatcgagagaaatctgacactgtaccacgtgatttatttggtcgcgaaatgatgtcgacttgggaaaagatggctgatcgtggactgatcacgaaacgtaagttggccaatctgaaaacaattccaggcagtattgacgcccacaaggcacaaggcttcatcaaccgtcaacttgttgaaacgcgtcaggtgatcaaactcgctgttggaattatgattgatcaatatcctgaaactcagattgtttcagttaaggctaatttgacccacgaaatgcgcgaaatgtttgatttggttaaaaatcgtgatgttaatgactaccatcatgcttttgatgcgtatttaaccgcttttgtaggtaattatttgctgcaacgttatcctaagcttgagccgtattttgtttacgacaagttcaagaaattaaaagatcaaaacatatccatgcgcgattttaatttgttgtatgacctaaagaagaatgaagacgtttatgatcagcgtactggtcactctgcacataaaatctgggaccagcacggaagcatcgactacattcgccacttattcgcatacaagaaaatactcgtgagccatgaagtgcatcagaatggtggcgcgctctacaatatgacggtttacggcaaagccgatgatgccaaacggaaattgattccaattaaagctgataaaccaacggagctctatggtggctacaccagccggaaacttgcttacatggcaatcgtaaagaccaagaagggaaagaaagaacagtatcaagttactggggttccggtttctgctttgacaacattacgccaatttaaggaagattcaccagaacagaaacaagcgctcgaagaaatcgttcgacgtaattttgatgaaaaaactgaagttgaaataattgtccctaaggtattgtttaatcagttgattgttgacgagaagtgcaggtttatggtcgggagcgatacgtatcgatataatgcgcagcaactagttttatcagctgatgatctagagattattaatgcctcacataaagacattcaaacgatagattcaagtgattactctcaacagcttgatcaagtttatcaaaatattttaacaatagtggacaagcattttccgatgtatgatattaataagtttcgaactaaattacatgatatttatgaacaatatattgaacttccaaatgaggatgtgtgggagaacaataaactaacaactttgggtaaacacactataatcattcgaattcttcagggattacatgctaatgcaaccgtagtagatttaaaacagttgggaattaaaactccatttggattcatgcaacaagctaggggaatagtggtttcacctgatgcccagttaatctatcaatctccgacgggtctttatgagcggcgtgttcgtttaggcgatttataa

SEQ ID NO: 386 - DNA, 3960 bp, Weissella halotolerans DSM 20190
atggcatatagtgtaggtcttgacattggtgtgggttcagttggctttgctgggattgataatcaatacaacctagttagaacgaagggtaaaaatgtgattggggtgcgcctatttgatgaggcagactcggcagcagaacgaagggggcataggactaatcggcggcgtttgcagcgccgacgttggcgactacgcttgttagatgacatctttgcaaaacccttacaagcggttgatcctaatttcttagctcgtttgaaatatagctatgtcaataaaaaggaccaggggcaacaggaccattattatggtggttacgtatttgggagtaccgcagcggatcaagcatatcatcaagcgtatccaactatttatcacttgagaaagagattaatggaagatgaccaaaaacatgatttgcgggaggtatatctggcaatccatcatattgtgaaataccggggtaactttttgaatcctcaatcctccttggatattgatcaacagtttgatgttactgattttgctcaggcattagctcgttttgcggatcatcaggcattaagctgggccttggaagctccaatacgtttcttggaggctgaattagcgactggcttgagtaatagtgcccgggtagatgccgccatagaagcctttagctttgatactaaagtggatcgagctgccatcaaggaaatgctgaagggacttagtggtaaccaaattgactttactaaactctttgtgaatgttgattcagctgattgggatcaggaagaacgaaagcaatggaaaatgaaactttctgaagaagactttgatgagcaggccttgccaatcttagaacgacttagccaggatgaaacagaattctttttggccattaaacgagcatatgatgggattgctttgatgcgttttttgggagatgagcaatcactgtcatcagctatgattaaagcctatgaagatcatcgacgggatttaacttttttaaaaacacaagtgcgaacaccgcagaatcgacaagctttatctgaaggctatacaaactacttaagtgtagacgataaaaaacataaacggggggctaaggagctagctcaattgatcgaagctagcgatgccagtgagcaagacaaagcaacgatgttggatcgcattgcgaatgaccagtttgcccctaagcaaaggactaaagctaatggattgattccttatcagttgcatttggctgaactaaagaaaattctagctaagcagggtcagtattatccatttttactggatacctttgctaaacagggccagtccgtaaataagatcgaggaattagttcagtttcgagttccatattatgtgggtccgatggtaccgaagtctgaaacagccgggaatgccgaaaatcattgggtagaaaaaaatgatggccaaacgaaagtgtcggtgacaccatggaactttgatcaagtttttaatcgtgatcgggcagctaaaagttttattgaccgattaacgggcaccgatacctatttaattggtgaaccaactcttccccggcattcactgacgtatgaaacatttacggttttgaatgagctgaataatattcggattgatggtaaacggttaccggtggaaacgaaacaagccattgtggaggaccttttcaaaaaatatcgattagtcactaagaaacgccttcaagattattttgcaagctttggaaaacgtgaggtcgagttaacgggtttggcagatgaaagccgctttactagtagtttgaccagttatcatgacttgcagggcctgctagggactgattttataactaatcctcaaaatcattcactgttggaaaagatagttgaaattcagacagtctttgaagatagtgacattgcagagcgtgaattaggcaagttaggcttagagcaaaaacttattccccgcctggctaaaaagcactataccggctggggtaatttgtcacgtaagttattagacacttcctttattcacgatccagaacggcctgaagagccagtttcaatcatggacttactctatacaacgaataaaaatttcatggaaatcctacatgattcagaatatggggtagaggaatggctaaaaagtcaaaatatgattgatgaccaaaaagatattcaaatgcgaattgatgaattaaccacctcaccagctaataaacggggaattaagcaagcctttaatgtcttggacgatattactcaagcgatgggggaggaaccagcttacgtctatctggaatttgcccgcgaaaaacaggcatcaagacgaacggtttcacgtaagaagcgactggagaccctatataaaaatgcagctttgaagactgaattcaaggctattaaagaagcactggccgaagaatcagatgaccgaatgcaagatgaccggttatacctgtattatgcgcagttgggtcgtgacatgtataccggtcaaagtatcagtattgatcagctgtcaagtcactatgatattgatcatatcgtgccccgtgctttcatcaaggatgattccttggaaaacaaggtcttagttaatcgaactgataatgcacggaagacagattcagccacctttacggccgatgttaaggctaaggcttttccgctttggcaacagttaaaaaaattaggactcatttcggctaaaaaatttaggcttctaacacgaactggcgattttacagagatggaacgcgagcggtttattgctcgacagttagttgaaacccgccaaattattaaaaatgtggcggctttgatagaaggccattttagtcaaacccaggcggtcgccattcgggctgaagtgactggtgaactgcgacagttgacgcaaattaagaaggaccgggatattaatgattatcaccatgcccaggatgctctgctagtagcgacagcaggaacttacctgcaccgtcattttcctaaacgagatgcccggtttatttataatgagtttgattattacacccagcactggctcaagaatcagggagagaaccgccgccggcatccttacagctttgtagtcggtacaatgagcaaaggtaatgaagattggacaccagataatttaaattatctgcgaaaagttatgcagtacaagaccatgctaatgactcggaaaccagtaggaccagaaggcgccctatataaggagactttaatcgcggctgaccctaagaaacgcttggtaggggccagtaaggaacggcaggatccaactatttatggtggctacactaaggaaagttcggcctatatgtctttagttcgggctggtgggaaaaatcagttggtaaagattccggtacggattgctaatgaaattcatagtggccaacgaaagttagacgactatgtgcaagcaaaggtaaaaaagtttgagcgaattctgttacccaagatttcattagggcaactcgtagaagatgagggtcaacgtttttatcttgcaaccaatgaaatgaaacacaatgctaagcagctctggctggatcaaaaggtggtgacaacttataaacgtttaactgctgaaagtccagttgaggattttttgactgtttttgatgctttgactagttcggctactatccaccattttaagttttatcagcgggatcttgaattacttagggacaatcgtgctggctttcaagacttagctaaggcaacgcaattaaaggtgttgaaggatgtgttgtatgagcttcacgataatgctggttggcgagatccaattaagcagtactttaaggaaataggattaaaagtacgcatgtggacaaaacttcagaaggaaggtggcattaaattaacagatcaagcagaacttatttatcaatcaccaagtggtttgtttgaaaagcgacgccgcgttcaggatttgctgtaa

SEQ ID NO: 387 - DNA, 4113 bp, Weissella kandleri DSM 20593
atggaaaaaaataaagagtacgtaattggattagatattgggactggttcagtggggtggtcagcgatatccacggataattatcaattgattcggcaaaagggtaagaatttaattggggtgcgtttatttaatagtgctgaaacggctgaagaacgacgtgggtatcggactaccagacgacgtctttcacggcggcgttggagaatgagtttactgaatgatatttttagacctgagttaaatgaaattgatgaaaattttttggcacgtttaaaatattcatgggttagtccactagatcagaaaaatccgcaattaaatgaacaaggaacgaatgctagtttatatggtgatatagaagctgatcaagcctttcatcgagcttatcctactatttatcatttgcgtaaaacattgatggaagataatcaaaaacatgatttacgcgaagtttatctagcaattcatcatattgtgaaataccgaggccattttttaacaccagattttgatgctaatagtcagactattgatatcaaaggattatttaagcaattaggtgatgtgagtggttctattgagttacaagctgatcaaacatcaacggtaatagcggcttttcagtcgattttgttagacttcactaagacccctactgagagtggacgattagcaggacaactttttagtgatcaaaataaggataaacaggctaagaagcaagttgaagagttgtttaagttattaagaggtggcaagggttcactggcagacatgtttttattaaccgatttggataaggtagtaaaaaatcaattaaaatttgcttttgatgatgcagttgatgaaaatctaaatcttatttccaatctgattaatgaagaacaatatgaactgttattaaacattcagaaattacgtgggactattattttaaagcaaattttaggtgatgatgagacggtgagcgacgctaaagtgcggagttatgaagaacatgctcatcagcttaaggagctaaaggcacaagtactgacgaaagataataaagagaaatttgaagaagcttatcaactaattcaaaaaggggatgcatcacgtattgatggtcttaagaaattgaagacgataattaatcaagagcacgaagccttacgattagataagtatgaggctgataaacttttgaaattaattgagcttgaccaattattaccagtgcaacgttctaagcgaaatggtgaaattcctcatcaattacatgaatttgaattaaagaaaataattgaaaagcaaggccgatattatccttttttgcgagaaacgtttgaacgcgatggtcaggaatttaataagataggacagctggttaattttaggattccttattacgttgggcccttggttgatccaaggttggctggtattcaatcgggtgatcagacgaatcattggatgacgcaaaagaaagcgggaaaaattacgccgtggaattatacggaattgattgatattgataaatctgcggctgaatttattaaacgcatgacggggactgacacgtatcttgtaggtgagccatcattacacaaggccagtttaatttatcaagactataacgttttgcaggaacttaataatttacgttatgacggtaagcccttgccggttgatgctaagcaggaaatttattcaaatttgcaagtgtcattaaagaatgcaacgaagaataaaattaatagtttccttatctctgaggggtatttgcaggatggagaagaattaactggttttgcaggaaaagaattgaagaataaattaagctcgttccattattttaaaaatattttcggccctgaacggatgaacactctggggacagataatttagagaaaattactgaattacagaccgtgtttgaagatcgccatatgttaaaacgccaacttcaaaaattaggatttttagatgatgatgaatgtgaaaagttagctggtaagcatttcactggttgggggaatttatcaaagaaattgttaaatacgccggccattatagatccagagattaatgaaaataaaattagtttaattgatgctttatataaagggcaacggaatcttagcttttatgttaataatatggatgataagtatcaatttcgtgattggattgaaagtgaaaatcaaagtcaacaggttgaaattagtttagatgaaaaaattaaaaatttagcaggatcaccagctattaaacgtgggattacacaaagtatggcagtgattcaagacattatcagagctaataatggaatttcaccaaaaagaatttatttggagtttgcgcgtgaatcgcagaattcgtatcaacctaattcacggataaaacagattgagaaaatttatgatcagaataagaaagagttaatgaaggtatatccagacgtttttaaagatgtacaaggtgtattgaataacgttgatgagaataattctctatcagaaaaagcatttttatatttcatgcaattaggtaaggatatgtataccggggaagctttggattttgacaaattatatacttatgatattgatcatatcattccgcaagctatgactaaagataattcatgggataacaaggtattggtgacagcaattaaaaatcgtgaaaagtctaatcaagttttagataatgctatccaagctaagatgcataatttttggttgcagttaaagaaagtgaatttattgagccaacgtaaatacgatacattaatgaagaccaacttcagcaaaggagacgaaaagaaatttatcgcgcgttcgttagtggaaacacgtcagattattaagaatgttgcagaattaattaagagtgagtttgatcatgttgaggcaattccgattcgacaagagttaacaagcgatatgcgtcagttaatggattataaaaagaaccgattagtgaacgattatcatcatgcccatgacgctctgcttattgcgacggtaggagagtttatgcaaaaacgcggatttatgcaaggaatgaatccatctcaaaatgtttatcatgggtatacgcaatatgttaaaaagtggttgagcatggctaaaaaagcaaggtccgctgaaaaacctgaacgcatttttccattacaattcgtggttggatcaatgcggatggctgtacgtgatggtcaagttgataaggttactcatccagctaccggagagatatgttggacagctgataatgaagcatatttgagaaaagttttgggttataaaaacattttggtgacacgtaaggttaaaaatgctggcaagttatatcaaagagtcacggtgaagcctaaaggtagtggtgaagcaccagttaatcatcaaaaatcagatattaatatttatggtggggtcactagtgaacaggcagcagagttggttttgattcggataaaagcaaagaataatgctaaaaatatggtgattaaaattccaacagctattgctaatcaggttgcaaataagaccactacgtatgatgcgtacgttcgaagcttaaatattccaaattatgctggaattattttggatcagattcctttaggtcaactggtttttgatgaaagaacaagtttttatctggcttctgcagagattaagcataatgctcgtcaactatgggtgaatcaacacattaataacgttttaactaaaaagaatatcaatgacgaggaaagagataatattttaaatttattgaccaatgagaagaatttagagcgatttaaactattagaacctgatttgaaacgggtgaaggcagctaaacaacagtgggcgagctgtgacgatcaagagcagatgcaaatattgaggattattatcaataaaatgcatgatgatgctagtccgcagattccaggaaaaatagacccatttaagaattacctagataagcaagggaaggggtggcgtgatttaagaactaaaaaaggaatgaaacttagtgataatgcagagtttgtttaccagtcaccaactggtttataccatcggaaaatatcaattaacgagttattaaaacaaaagcaattagaatag

SEQ ID NO: 388 - DNA, 4200 bp, Olsenella uli
atgaatcttcgcaatactacagacgagtacaacatcggtctggacatgggcaccaactccgttggatgggcagttacagataaagctggggccatcgcgcacttcaagggcaagcccactctgggtagcaggcttttcgacgcagcgcaaactgctgcaggggcgcgtatacaccgcagccaacggcgtcgttatgttcgcaggcgttggcggctcgaccttctacagagtctcttccaagatgaggtcagcaaggttgactcagagttcttttgcaggcttagacaatcgcgcctgtatgtgggagatagggaaaagggacatgcggattacacatggcccatcttcaatgactcagacttcaacgaagtggattattacaagcgctttcctaccatttaccacctacgcaaatggctgatggaaacggacgagaaagccgacattcgtctcatctatcttgctactcataacatcgtgaagcataggggcaacttcctgcgtgagaacaacaagagtctgagttctcgtgatgcaaatcctgctcaggcggtgaagagtctgcgactggctttgaacgattggtgttcggagcgtgactatgagtgcgcttggaaaggcgaggaagatgatggtgctatcgacgaggccattctcaatgtgctggctgatggcgagaaagggcgcagcgaccaggcaaaggagattgccaagctaactggtgtcgattgtggggacgcaaagcagagcaagcagtgtaacgaggcaatcgctaaggcaatcgtcggactcaaggtggagatgaagaacatcttcggtgagtttcctgctgagaagacatcatacatttatttgtcgtctgacgaagatgtcgaggccgttcgtgaatcctgtcctgatgatagtggagaattgttccaggcgctttgcaagttgtactcagcctacatcttgcaggagctcctttcttatgcagatccatcaggccagaccatctcggccaacatggttgccaagtacaagcagtacggaagagacttgagactgctcaaggagcttacacgtacatatgcgccacagaaatacgacttatttttccgtggtgagacatatgcggggtcaagcgactacgtcgtagacgaggcgcgggggtatacccgatataaccttggtaccacaaaggcgaactatgatgacttccagaagtcagtcaaggaactcttcaagggaacggatgcgctgcaggatgagcgttaccaagagatgatggtagcctttggcgagcagaagtttcttcgcaggctcaagacgagcgataacgggagcatctactaccagcttcatctagaggagttgcataccatcctcgaaaaccaggggaaacactatcccttcctcctgtctgaagaagacaagattgagtcgctcgtgtccttcaggattccctattatgtggggccgcttaccaggaaaaatgccgcgattggccatgacggtaaagagcgctttgcatggtcatcacgcaaggatggtatggagcatgctgtcatcaccccatggaactgggaagagatcatcgatcgcgataagagtgccgaagacttcataatgcgcatgacgggtgactgcacctacctccagggggagcccgtcctccccaagtgctctctgctctatgaggaattctgtgctctcaacgaatttaacggtgcgcattggacggttgatggggacgatgagcgtcgttttgacgccgcccaacgcgagcgcatcatgtgcgacttgttcagaagaactcgttccgtcacatacaataaggtctccgattggttggagcgcaaatacaattttacaggtgctcgtgtgcgcggaggacagggagagcatgggtttgagtcaaagctcggctcgtatatcttcttctgtaaggacgtattcaaaactgacgggctggacgaggccgactatacgatgatcgagcagatcatcctttggagcacgctatttgaggatagggacattctcaagcggaagatcgaggaagcatacggtggtgataggctgacctccgagcagataaaggtcatctgcaagaaacgctttacgggctggggacggctatcgaagagactcctcacggacattaaggtcaatacggatactggtcgcaagtcgattatggatgtgctgcgtgaggggaatccgaacaatggccaacgttctcgcacgatggtctttatggaagtgctccgtgacgaggaccttggcttccagaaggctattgatggcctcaacagggattatttccgcgagcacaataatggccttatggatgtaaatgacctacctgggtctcctgcgattcggagaagtatcaaccaggctgtacgcattgtggatgagatcgcctctattgcgaggaaagagcccaccaacatcttcattgaggtgacacgtgaggaggatgatccacgcaagaaaggcaagcgcaccaagagacgctatgacgcaatcaagagcgccctcgaaaaatttaagaaagatgatccatcgctttggaaagaactgtgcgaaaaagcaccgggggatatggacgaacggctctcgttgtacttcatgcaacggggtaagtgcatgtactcagggcgtccaatcaagattgaggagctacatactggaaaatacgaggttgatcacatcattccacgctcgtacataaaggatgacagcttcgagaacaaggtgctcgtgtaccgcgaggagaaccagcataagacggacgcgttgcttatcgattcctctatcaggcagaagatgggcggatactggcgtatgctgcatgacgcaaagctggtgggcgacaagaagttcaggaatctcttccgcaaccatattgatgataaggccatgaaggggtttgtcgcgcggcagatcgtcgagaccagccagatggtcaagcttgttcagacactgtttgaggcgaggtatccaaacacgcggatcgtgccggtgaaggctggcatctcgcatgatttgcgtgaagcagctggtctagtcaaatgccgtgaggccaatgatttccaccatgcgcacgacgctttccttgcctgtcgtatcggcctcttcatccagaagcgtcatcccagcgtctatgacaatcccattgggcttgcgcgcatcatgcgcgactatgctcgtatgcaggcgcgggagtataagaagtctcactgtcttgcacatacgcagggctttatcgttaacagcttccttagctcgggttttgatgaggagacaggcgagatattcaaggacgattgggatgctaaggctgaggtcgaggggatccgtcgcgtgcttaactgtcgccagtgctttataagccgtatgcccgtggagggagatacacgatatggtggccgctattggggagagacaatatattctcctaagggcaagcataagcatgagatacctctgaagcaagggcttgacccaaatctgtatggtggctactccgacctgctttactcatactttcttatttatgaagcgagtgacgtctcgtcgggagaaagagtactcaggttcataggaatcccgacatccattgctgctcgaatggccaatcagaaaaggctggaagaatacgtttctcgtctagctctccaagagaatcttgaacatgttcgcatggttcgcaagataatgaaaaagcagctgattgaagtagataactgcaggctgttggtaactgctgcagatgcagtaaccaacgcaactgaactcgctttttcgctagatgagatgaagataataagtacctgtgccaagtgcatcaatggagcagatcctagcgctatcgataaaattggcaatgctcaagatagtttctttgacaacttgaagcggaggggctctgataggtgcgcccttttattttcccagttaaagctcgacaaactttctcaaaacttttatatgatctcttccgacgataaatctaaaatccttatcagcattctggacaggattagggctaagagtaattcggttgacttgagcttagttgggggagcaaagcatgctgcccagatgaagttcgacttcaatgcaaagttgaataatcctgctagcagctttgtcctcatcgaccagtccgtgacaggcatgtttgagaggcggactcgcattgggctttag

SEQ ID NO: 389 - RNA, 116 nt, Pediococcus parvulus
ucggagagagggaggaugcaguuuuagaagagugucgaaucgaaauuugacgcucuggguuaaaaucaaacaaagcuuuaugcugaguuuuaucuuuugaguccgcuaucggacca

SEQ ID NO: 390 - DNA, 35 bp, Pediococcus parvulus
  misc_feature (4)..(5): n is a, c, g, or t
tctnntgtatcctcactctctccgacagtcacctc

SEQ ID NO: 391 - DNA, 30 bp, Pediococcus parvulus
gaggtgactgtcggagagagtgaggataca

SEQ ID NO: 392 - RNA, 118 nt, Lactobacillus buchneri
uaagccgcaauauccguuuguuuuagaaggauguuaaaucgaaauuuaacauccuguguuaaaaucaagcaaagcgcuuugcgcggaguuucaacuuuugacccauuauaugggcauu

SEQ ID NO: 393 - DNA, 60 bp, Lactobacillus buchneri
tgctcgctgactggttttataaacggtattgcggcttatattacgagctgaaatgattag

SEQ ID NO: 394 - DNA, 61 bp, Lactobacillus buchneri
ctaatcatttcagctcgttaatataagccgcaatatccgtttataaaaccgtcagcgagca

SEQ ID NO: 395 - RNA, 111 nt, Lactobacillus jensenii
gauuugauuaacugguauacguuuuagaagguugaaaaaccuuauuuuuaaaaucaaacaaggucuuaguaccgaguuuucacauguguaccgcuuauagcggucuuuuuu

SEQ ID NO: 396 - DNA, 71 bp, Lactobacillus jensenii
tgcagcttgagttactgtcttgttgccagtataccagttaatcaaatctccacggtattgttggtaatcag

SEQ ID NO: 397 - DNA, 71 bp, Lactobacillus jensenii
ctgattaccaacaataccgtggagatttgattaactggtatactggcaacaagacagtaactcaagctgca

SEQ ID NO: 398 - RNA, 129 nt, Lactobacillus gasseri
gauuugauuaacugguauacguuuuagaugguuguuagaucgaaaucuaacaaccagauuuaaaaucaagcaaugcaucuuuugaugcaaaguuucaauacuugucccgagcuaucgagggacuuuuuu

SEQ ID NO: 399 - DNA, 72 bp, Lactobacillus gasseri
tgcagcttgagttactgtcttgttgttaagtataccagttaatcaaatctccacggtattgttggtaatcag

SEQ ID NO: 400 - DNA, 72 bp, Lactobacillus gasseri
ctgattaccaacaataccgtggagatttgattaactggtatacttaacaacaagacagtaactcaagctgca

SEQ ID NO: 401 - RNA, 117 nt, Lactobacillus rhamnosus
gccaauaucaagcuauaugcgucucagguagaugucagaucgaaaucugacaucucacgaguugagaucaaacaaagcuucagcugaguuucaauuucugagcccauguugggccau

SEQ ID NO: 402 - DNA, 72 bp, Lactobacillus rhamnosus
agtgattacaagtccacggtatttttcggcatatagcttgatattggccgcaagctcgttagagatcagcac

SEQ ID NO: 403 - DNA, 71 bp, Lactobacillus rhamnosus
gtgctgactctaacgagcttgcggccaatatcaagctatatgccgaaaaataccgtggacttgtaatcact

SEQ ID NO: 404 - RNA, 118 nt, Lactobacillus pentosus
cauugcuuuaaaaauggcaagucuugaauaguagucauaucgaaauaugacuacuagcgucaagaucaaacaaggcauuuugccgaguuucaccuuuugaguccguauucggaccauu

SEQ ID NO: 405 - DNA, 47 bp, Lactobacillus pentosus
  misc_feature (2)..(3): n is a, c, g, or t
cnnttgccatttttaaagcaatgcgcacttacacacaacaactaaag

SEQ ID NO: 406 - DNA, 46 bp, Lactobacillus pentosus
  misc_feature (44)..(45): n is a, c, g, or t
ctttagttgttgtgtgtaagtgcgcattgctttaaaaatggcanng

SEQ ID NO: 407 - RNA, 119 nt, Lactobacillus animalis
gauuugauuaacugguauacguuuuagagcuauguuguuggaaaacaacauuagcgaaguuaaaauaagguuuaauccguaaucaacaaguuuaucuugcgcgcgccguucggcgcuuu

SEQ ID NO: 408 - DNA, 50 bp, Lactobacillus animalis
actgtcttgttgcaagtataccagttaatcaaatctccacggtattgttg

SEQ ID NO: 409 - DNA, 52 bp, Lactobacillus animalis
ccaccaataccgtggagatttgattaactggtatacttgcaacaagacaggt

SEQ ID NO: 410 - RNA, 112 nt, Lactobacillus cacaonum
cgcauugcuuaaaaauggcaaguuuuuguacucucaacauuuuccgaaaaaugauugagaaucuacaaagauaaggcuuuaugccgaaaugacugccuuuauggcaguuuuu

SEQ ID NO: 411 - DNA, 51 bp, Lactobacillus cacaonum
  misc_feature (2)..(3): n is a, c, g, or t
  misc_feature (5)..(7): n is a, c, g, or t
tnntnnnttgccatttttaaagcaatgcgcacttacacacaacaactaaag

SEQ ID NO: 412 - DNA, 50 bp, Lactobacillus cacaonum
  misc_feature (44)..(46): n is a, c, g, or t
  misc_feature (48)..(49): n is a, c, g, or t
cttagttgttgtgtgtaagtgcgcattgctttaaaaatggcaannnanna

SEQ ID NO: 413 - RNA, 120 nt, Lactobacillus mali
aaaaaugaauggcaccauacuaggcguaguguuuuugcacucucaacauuuuccgaaaaaugauugagaaucugcaaagauaaggcuuuaugccgaaauuacugccucuuaggcaguuuu

SEQ ID NO: 414 - DNA, 61 bp, Lactobacillus mali
ggtacacaatttgcttatcaactacgcctagtatggtgccattgatttttccctccccctt

SEQ ID NO: 415 - DNA, 60 bp, Lactobacillus mali
aagggggagggaaaaatgaatggcaccatactaggcgtagttgataagcaaattgtgacc

SEQ ID NO: 416 - RNA, 116 nt, Lactobacillus cacaonum
gauuugauuaacugguauacgcuucagaugugugaaaacacagcauugaaguaaagcaagauuaauuucaagcuuaauuuucuucacauuuaugugcagaagggcuuaugcccaca

SEQ ID NO: 417 - DNA, 56 bp, Oenococcus kitaharae
tgagttactgtcttgttgcaagtataccagttaatcaaatctccacggtattgttg

SEQ ID NO: 418 - DNA, 56 bp, Oenococcus kitaharae
caacaataccgtggagatttgattaactggtatacttgcaacaagacagtaactca

SEQ ID NO: 419 - DNA, 47 bp, Lactobacillus gasseri
ctcgagtaatgcttcgaaatgttactattcaggtaactaacctgcag

SEQ ID NO: 420 - DNA, 47 bp, Lactobacillus gasseri
ctcgagtaatgcttcgaaatgttactattcaggtaaccaacctgcag

SEQ ID NO: 421 - DNA, 47 bp, Lactobacillus gasseri
ctcgagtaatgcttcgaaatgttactattcaggtaactaaactgcag

SEQ ID NO: 422 - DNA, 47 bp, Lactobacillus gasseri
ctcgagtaatgcttcgaaatgttactattcaggtaactcacctgcag

SEQ ID NO: 423 - DNA, 47 bp, Lactobacillus gasseri
ctcgagtaatgcttcgaaatgttactattcaggtaactaccctgcag

SEQ ID NO: 424 - DNA, 47 bp, Lactobacillus gasseri
ctcgagtaatgcttcgaaatgttactattcaggtaacctaactgcag

SEQ ID NO: 425 - DNA, 47 bp, Lactobacillus gasseri
ctcgagtaatgcttcgaaatgttactattcaggtaattggcctgcag

SEQ ID NO: 426 - DNA, 47 bp, Lactobacillus gasseri
ctcgagatttaaaatggatcaggccaaaattaaggactaacctgcag

SEQ ID NO: 427 - DNA, 47 bp, Lactobacillus rhamnosus
gagctcaagaaacgatcccgagtttctggattgcttagaaagagctc

SEQ ID NO: 428 - DNA, 47 bp, Lactobacillus rhamnosus
gagctcaagaaacgatcccgagtttctggattgcttcccccgagctc

SEQ ID NO: 429 - DNA, 47 bp, Lactobacillus rhamnosus
gagctcaagaaacgatcccgagtttctggattgcttagaacgagctc

SEQ ID NO: 430 - DNA, 47 bp, Lactobacillus rhamnosus
gagctcaagaaacgatcccgagtttctggattgcttagcccgagctc

SEQ ID NO: 431 - DNA, 47 bp, Lactobacillus rhamnosus
gagctcaagaaacgatcccgagtttctggattgcttccaacgagctc

SEQ ID NO: 432 - DNA, 47 bp, Lactobacillus rhamnosus
gagctcaagaaacgatcccgagtttctggattgcttccaaagagctc

SEQ ID NO: 433 - DNA, 47 bp, Lactobacillus rhamnosus
gagctcaagaaacgatcccgagtttctggattgcttagaccgagctc

SEQ ID NO: 434 - DNA, 47 bp, Lactobacillus rhamnosus
gagctcattgccaacttgtagaattgcggttcagtgagaaagagctc

SEQ ID NO: 435 - DNA, 36 bp, Lactobacillus casei; identical to SEQ ID NO: 12

SEQ ID NO: 436 - DNA, 36 bp, Lactobacillus rhamnosus; identical to SEQ ID NO: 56

SEQ ID NO: 437 - DNA, 36 bp, Lactobacillus gasseri; identical to SEQ ID NO: 34

SEQ ID NO: 438 - DNA, 36 bp, Lactobacillus jensenii; identical to SEQ ID NO: 33

SEQ ID NO: 439 - DNA, 36 bp, Lactobacillus pentosus; identical to SEQ ID NO: 51

That which is claimed is:

1. A protein-chimeric RNA complex comprising:
   (a) a Cas9 polypeptide comprising an amino acid sequence having at least about 80% identity to the amino acid sequence of any of SEQ ID NO:220, and/or a functional fragment thereof; and
   (b) a chimeric RNA comprising: (i) a Clustered Regularly Interspaced Short Palindromic Repeats (CRISPR) RNA (crRNA) comprising a 3' region and a 5' region, wherein the 3' region comprises at least about 10 consecutive nucleotides of a CRISPR repeat comprising the nucleotide sequence of SEQ ID NO:27, and the 5' region comprises at least about 10 consecutive nucleotides of a spacer sequence located upstream of the repeat; and
   (ii) a trans-activating crRNA (tracrRNA) comprising a 5' and 3' region wherein at least a portion of the 5' region of the tracrRNA is complementary to the 3' region (CRISPR repeat) of the crRNA and the 3' region of said tracrRNA forms a secondary structure, wherein the tracrRNA comprises nucleotides 46 to 129 of the nucleotide sequence of SEQ ID NO:398.

2. The complex of claim 1, wherein the 5' region of the tracrRNA comprises at least about 10 nucleotides complementary to the at least 10 consecutive nucleotides of the 3' region of the crRNA.

3. The complex of claim 1, wherein the polypeptide comprises a HNH motif and a RuvC motif.

4. An expression cassette comprising the nucleotide sequence comprising or encoding the protein-chimeric RNA complex of claim 1.

5. A vector comprising the expression cassette of claim 4.

6. A cell comprising the chimeric protein-RNA complex of claim 1, the expression cassette of claim 4.

7. The cell of claim 6, wherein the cell is a plant cell, bacteria cell, fungal cell, mammalian cell, insect cell, or archaeon cell.

8. A method for site-specific cleavage of a target DNA, comprising:
   contacting the target DNA with the protein-chimeric RNA complex of claim 1, thereby producing a site specific cleavage of the target DNA in a region defined by complementary binding of the spacer sequence of the crRNA of said complex to the target DNA.

9. A method of transcriptional control of a target DNA, comprising:
   contacting the target DNA with the protein-chimeric RNA complex of claim 1, wherein the Cas9 polypeptide of the complex is deactivated and the complex binds to the target DNA, thereby controlling the transcription of the target DNA.

10. A method of editing DNA, comprising:
    contacting the target DNA with the protein-chimeric RNA complex of claim 1, wherein the complex binds to the target DNA, thereby editing the target DNA.

11. A method for cleaving a double stranded (ds) polynucleotide, comprising contacting said ds polynucleotide with the protein-chimeric RNA complex of claim 1, wherein the ds polynucleotide comprises
    (a) a protospacer sequence comprising a sequence that is least 80% complementary to the spacer sequence in the crRNA in said complex, and
    (b) a protospacer adjacent motif (PAM) comprising a nucleotide sequence of any one of the nucleotide sequences (5' to 3') of CTAACC; CCAAC; CTAAAC; CTCAC; CTAC; CCTAAC; TTGGCC; or CTAAC downstream from the protospacer sequence, thereby cleaving the polynucleotide in the region defined by complementary binding of the spacer sequence of the crRNA to the polynucleotide.

12. The method of claim 11, wherein the polypeptide of the complex cleaves both strands of the polynucleotide at a cleavage site located 0 to 3 nucleotides upstream of the PAM sequence to create blunt ends.

13. A method for site-specific nicking of a (+) strand of a double stranded target DNA, comprising contacting a protein-chimeric RNA complex with a double stranded target DNA, wherein the protein-chimeric RNA complex comprises
    (a) a crRNA comprising a 3' region and a 5' region, wherein the 3' region comprises at least about 10 consecutive nucleotides of a CRISPR repeat comprising the nucleotide sequence of SEQ ID NO:27, and the 5' region comprises at least about 10 consecutive nucleotides of a spacer sequence located upstream of the repeat,
    (b) to tracRNA comprising a 5' and 3' region wherein at least a portion of the 5' region of the tracRNA is complementary to the 3' region (CRISPR repeat) of the crRNA, wherein the tracRNA comprises nucleotides 46 to 129 of the nucleotide sequence of SEQ ID NO:398, and
    (c) a polypeptide comprising an amino acid sequence of any of SEQ ID NO:220, or a functional fragment thereof, comprising a point mutation in an RuvC active site motif; and the target DNA comprises a protospacer sequence that is at least about 80% complementary to the spacer sequence in the crRNA, and a protospacer adjacent motif (PAM) sequence of any one of the nucleotide sequences (5' to 3') of CTAACC; CCAAC; CTAAAC; CTCAC; CTAC; CCTAAC; TTGGCC; or CTAAC downstream from the proto-spacer sequence, wherein the polypeptide cleaves the (+) strand of the double stranded DNA at a cleavage site located 0 to 3 nucleotides upstream of the PAM sequence, thereby producing a site-specific nick in said double stranded target DNA.

14. A method for site-specific nicking of the (−) strand of a double stranded target DNA, comprising contacting protein-chimeric RNA complex of claim 1 with a double stranded target DNA, wherein the Cas9 polypeptide comprises a point mutation in an HNH active site motif; and the target DNA comprises a protospacer sequence that is at least about 80% complementary to the spacer sequence in the crRNA and a protospacer adjacent motif (PAM) sequence comprising a nucleotide sequence of any one of the nucleotide sequences (5' to 3') of CTAACC; CCAAC; CTAAAC; CTCAC; CTAC; CCTAAC; TTGGCC; or CTAAC downstream from the protospacer sequence, wherein the polypeptide cleaves the (−) strand of the double stranded DNA at a cleavage site located 0 to 3 nucleotides upstream of the PAM sequence resulting in site-specific nicking of the target DNA.

15. The method of claim 8, wherein the Cas9 polypeptide is codon optimized for an organism comprising the target DNA.

16. The method of claim 15, wherein the organism is a plant, bacteria, fungus, mammal, insect, or archaeon.

17. The method of claim 16, wherein the organism is *Homo sapiens, Drosophila melanogaster, Mus musculus, Rattus norvegicus, Caenorhabditis elegans*, or *Arabidopsis thaliana*.

* * * * *

UNITED STATES PATENT AND TRADEMARK OFFICE
CERTIFICATE OF CORRECTION

Page 1 of 2

PATENT NO. : 10,450,584 B2
APPLICATION NO. : 15/507176
DATED : October 22, 2019
INVENTOR(S) : Barrangou et al.

It is certified that error appears in the above-identified patent and that said Letters Patent is hereby corrected as shown below:

On the Title Page

Item (56) References Cited, FOREIGN PATENT DOCUMENTS, Page 2, Column 1, Line 32 (as counted from Column 2): Please correct "WO 20141191518 12/2014" to read -- WO 2014/191518 12/2014 --

Item (56) References Cited, FOREIGN PATENT DOCUMENTS, Page 2, Column 1, Line 59 (as counted from Column 2): Please correct "WO 2016/177682 6/2016" to read -- WO 2016/177682 11/2016 --

Item (56) References Cited, OTHER PUBLICATIONS, Page 2, Column 2, Line 59, Deltcheva, E. et al. cite: Please correct "factot" to read -- factor --

Item (56) References Cited, OTHER PUBLICATIONS, Page 3, Column 1, Line 6 (as counted from Column 2), Fonfara, I. et al. cite: Please correct "orthoIogous" to read -- orthologous --

Item (56) References Cited, OTHER PUBLICATIONS, Page 3, Column 1, Line 11 (as counted from Column 2), Garneau JE, et al. cite: Please correct "piasmid" to read -- plasmid --

Item (56) References Cited, OTHER PUBLICATIONS, Page 3, Column 1, Line 26 (as counted from Column 2), Haurwitz et al. cite: Please correct "Endonuolease" to read -- Endonuclease --

Item (56) References Cited, OTHER PUBLICATIONS, Page 3, Column 2, Line 29, Sapranauskas et al. cite: Please correct "*coiI*" to read -- *coli* --

Item (56) References Cited, OTHER PUBLICATIONS, Page 3, Column 2, Line 33, Seed et al. cite: Please correct "pp. 489-491." to read -- pp. 489-491. (2013) --

Item (56) References Cited, OTHER PUBLICATIONS, Page 3, Column 2, Line 40, 3rd Selle, K. et al. cite: Please correct "Technciogies" to read -- Technologies --

Signed and Sealed this
Thirty-first Day of March, 2020

Andrei Iancu
*Director of the United States Patent and Trademark Office*

CERTIFICATE OF CORRECTION (continued)
U.S. Pat. No. 10,450,584 B2

Item (56) References Cited, OTHER PUBLICATIONS, Page 4, Column 2, Line 1, Final Office Action cite: Please correct "Jul. 30, 2013" to read -- Jul. 30, 2018 --

Item (56) References Cited, OTHER PUBLICATIONS, Page 4, Column 2, Line 5, 1st Liu S et al. cite: Please correct "4010-4020" to read -- 4019-4020 --

Item (56) References Cited, OTHER PUBLICATIONS, Page 4, Column 2, Line 19, Database GenBank cite: Please correct "KFF312559" to read -- KFF31259 --

In the Specification

Column 4, Line 44: Please correct "5-NNAAC-'" to read -- 5-NNAAC-3' --

Column 7, Line 11: Please correct "NHN" to read -- HNH --

Column 8, Line 39: Please correct "SEQ ID N0:395" to read -- SEQ ID NO:395 --

Column 28, Line 28: Please correct "NHN" to read -- HNH --

Column 31, Line 53: Please correct "UCC 118" to read -- TCC 118 --